US009243301B2

(12) United States Patent
Foster et al.

(10) Patent No.: US 9,243,301 B2
(45) Date of Patent: *Jan. 26, 2016

(54) FUSION PROTEINS

(75) Inventors: Keith Foster, Salisbury (GB); John Chaddock, Salisbury (GB); Philip Marks, Abingdon (GB); Patrick Stancombe, Salisbury (GB); Kei Roger Aoki, Irvine, CA (US); Joseph Francis, Irvine, CA (US); Lance Steward, Irvine, CA (US)

(73) Assignees: Allergan, Inc., Irvine, CA (US); Ipsen Bioinnovation Limited, Abingdon (GB)

( * ) Notice: Subject to any disclaimer, the term of this patent is extended or adjusted under 35 U.S.C. 154(b) by 554 days.

This patent is subject to a terminal disclaimer.

(21) Appl. No.: 13/419,381

(22) Filed: Mar. 13, 2012

(65) Prior Publication Data

US 2012/0230975 A1 Sep. 13, 2012

Related U.S. Application Data

(63) Continuation-in-part of application No. 12/303,078, filed as application No. PCT/GB2007/002049 on Jun. 1, 2007, now abandoned.

(30) Foreign Application Priority Data

Jun. 1, 2006 (GB) ..................................... 0610864

(51) Int. Cl.
*A61K 38/00* (2006.01)
*C12N 9/52* (2006.01)
*C12N 15/62* (2006.01)
*C07K 14/665* (2006.01)

(52) U.S. Cl.
CPC ....... *C12Y 304/24069* (2013.01); *C07K 14/665* (2013.01); *C12N 9/52* (2013.01); *C12N 15/62* (2013.01); *A61K 38/00* (2013.01); *C07K 2319/055* (2013.01)

(58) Field of Classification Search
None
See application file for complete search history.

(56) References Cited

U.S. PATENT DOCUMENTS

| | | |
|---|---|---|
| 5,989,545 A | 11/1999 | Foster |
| 6,136,564 A | 10/2000 | Kopetzki |
| 6,395,513 B1 | 5/2002 | Foster |
| 6,461,617 B1 | 10/2002 | Shone |
| 6,776,990 B2 | 8/2004 | Sachs |
| 6,843,998 B1 | 1/2005 | Steward |
| 7,056,729 B2 | 6/2006 | Donovan |
| 7,132,259 B1 | 11/2006 | Dolly |
| 7,244,436 B2 | 7/2007 | Donovan |
| 7,244,437 B2 | 7/2007 | Donovan |
| 7,262,291 B2 | 8/2007 | Donovan |
| 7,276,473 B2 | 10/2007 | Sachs |
| 7,413,742 B2 | 8/2008 | Donovan |
| 7,419,676 B2 | 9/2008 | Dolly |
| 7,422,877 B2 | 9/2008 | Dolly |
| 7,494,661 B2 | 2/2009 | Sanders |
| 7,514,088 B2 | 4/2009 | Steward |
| 7,658,933 B2 | 2/2010 | Foster |
| 7,659,092 B2 | 2/2010 | Foster |
| 7,709,228 B2 | 5/2010 | Dolly |
| 7,736,659 B2 | 6/2010 | Donovan |
| 7,740,868 B2 | 6/2010 | Steward |
| 7,749,514 B2 | 7/2010 | Steward |
| 7,780,968 B2 | 8/2010 | Donovan |
| 7,785,606 B2 | 8/2010 | Ichtchenko |
| 7,817,957 B2 | 10/2010 | Oohara |
| 7,833,535 B2 | 11/2010 | Donovan |
| 7,887,810 B2 | 2/2011 | Foster |
| 7,892,560 B2 | 2/2011 | Foster |
| 8,067,200 B2 | 11/2011 | Foster |
| 8,187,834 B2 | 5/2012 | Foster |
| 8,399,400 B2 * | 3/2013 | Foster et al. ..................... 514/1 |

(Continued)

FOREIGN PATENT DOCUMENTS

| | | |
|---|---|---|
| EP | 1422240 A2 | 5/2004 |
| WO | 96/33273 A1 | 10/1996 |

(Continued)

OTHER PUBLICATIONS

Office Action mailed Jun. 28, 2011, issued in related Japanese Application No. 2007-543906, 9 pages.
Office Action mailed Jun. 28, 2011, issued in related Japanese Application No. 2007-543908, 8 pages.
Final Office Action mailed Jun. 26, 2012, issued in related Japanese Application No. 2007-543906, 10 pages.
Final Office Action mailed Jun. 26, 2012, issued in related Japanese Application No. 2007-543908, 7 pages.
Office Action mailed Jun. 29, 2012, issued in related Chinese Application No. 200780028089.0, 12 pages.
Office Action mailed Aug. 22, 2012, issued in related Canadian Application No. 2595115, filed May 30, 2007, 4 pages.

(Continued)

*Primary Examiner* — Nashaat Nashed
*Assistant Examiner* — William W Moore
(74) *Attorney, Agent, or Firm* — Christensen O'Connor Johnson Kindness PLLC

(57) ABSTRACT

A single chain, polypeptide fusion protein, comprising: a non-cytotoxic protease, or a fragment thereof, which protease or protease fragment can cleave a protein of the exocytic fusion apparatus of a nociceptive sensory afferent; a Targeting Moiety that can bind to a Binding Site on the nociceptive sensory afferent, which Binding Site can undergo endocytosis to be incorporated into an endosome within the nociceptive sensory afferent; a protease cleavage site at which site the fusion protein is cleavable by a protease, which is located between the non-cytotoxic protease and the Targeting Moiety; and a translocation domain that can translocate the protease or protease fragment from within an endosome, across the endosomal membrane and into the cytosol of the nociceptive sensory afferent; wherein the Targeting Moiety is BAM, β-endorphin, bradykinin, substance P, dynorphin and/or nociceptin. Nucleic acid sequences encoding the fusion proteins, methods of preparing same and uses thereof are also described.

2 Claims, 42 Drawing Sheets

(56) References Cited

U.S. PATENT DOCUMENTS

| | | | |
|---|---|---|---|
| 8,399,401 B2 * | 3/2013 | Foster et al. | 514/1 |
| 8,455,203 B2 * | 6/2013 | Wang et al. | 435/7.1 |
| 8,512,984 B2 * | 8/2013 | Foster et al. | 435/69.7 |
| 8,603,779 B2 * | 12/2013 | Foster et al. | 435/69.7 |
| 8,778,634 B2 * | 7/2014 | Foster et al. | 435/69.1 |
| 8,940,870 B2 * | 1/2015 | Foster et al. | 530/350 |
| 2003/0166571 A1 | 9/2003 | Judd | |
| 2004/0115727 A1 | 6/2004 | Steward | |
| 2005/0095251 A1 | 5/2005 | Steward | |
| 2006/0051356 A1 | 3/2006 | Foster | |
| 2007/0010475 A1 | 1/2007 | Richardson | |
| 2007/0066559 A1 | 3/2007 | Richardson | |
| 2008/0025994 A1 | 1/2008 | Steward | |
| 2008/0032931 A1 | 2/2008 | Steward | |
| 2008/0182294 A1 | 7/2008 | Dolly | |
| 2008/0311622 A1 | 12/2008 | Dolly | |
| 2009/0004224 A1 | 1/2009 | Steward | |
| 2009/0005313 A1 | 1/2009 | Steward | |
| 2009/0018081 A1 | 1/2009 | Steward | |
| 2009/0030182 A1 | 1/2009 | Dolly | |
| 2009/0030188 A1 | 1/2009 | Dolly | |
| 2009/0042270 A1 | 2/2009 | Dolly | |
| 2009/0069238 A1 | 3/2009 | Steward | |
| 2009/0081730 A1 | 3/2009 | Dolly | |
| 2009/0087458 A1 | 4/2009 | Dolly | |
| 2009/0104234 A1 | 4/2009 | Francis | |
| 2009/0117157 A1 | 5/2009 | Brin | |
| 2009/0162341 A1 | 6/2009 | Foster | |
| 2010/0055761 A1 | 3/2010 | Seed | |
| 2010/0196421 A1 | 8/2010 | Ichtchenko | |
| 2010/0209955 A1 | 8/2010 | Oyler | |
| 2010/0247509 A1 | 9/2010 | Foster | |
| 2010/0303757 A1 | 12/2010 | Francis | |
| 2010/0303789 A1 | 12/2010 | Francis | |
| 2010/0303791 A1 | 12/2010 | Francis | |
| 2011/0027256 A1 | 2/2011 | Foster | |
| 2011/0091437 A1 | 4/2011 | Foster | |
| 2011/0177053 A1 | 7/2011 | Foster | |
| 2012/0058098 A1 | 3/2012 | Foster | |
| 2012/0064059 A1 | 3/2012 | Foster | |
| 2012/0156186 A1 | 6/2012 | Foster | |
| 2012/0189610 A1 | 7/2012 | Foster | |
| 2012/0207735 A1 | 8/2012 | Foster | |
| 2013/0189238 A1 | 7/2013 | Foster | |
| 2013/0267010 A1 * | 10/2013 | Wang et al. | 435/219 |
| 2013/0295643 A1 * | 11/2013 | Foster et al. | 435/188 |
| 2014/0056870 A1 | 2/2014 | James | |
| 2014/0294797 A1 * | 10/2014 | Foster et al. | 424/94.3 |

FOREIGN PATENT DOCUMENTS

| | | |
|---|---|---|
| WO | 9807864 A1 | 2/1998 |
| WO | 9917806 A1 | 4/1999 |
| WO | 01/58936 A2 | 8/2001 |
| WO | 2004/024909 A2 | 3/2004 |
| WO | 2006026780 A1 | 3/2006 |
| WO | 2006059093 A2 | 6/2006 |
| WO | 2006059105 A2 | 6/2006 |
| WO | 2006059113 A2 | 6/2006 |
| WO | 2007138339 A2 | 12/2007 |
| WO | 2010/105236 A1 | 9/2010 |
| WO | 2012/156743 A1 | 11/2012 |

OTHER PUBLICATIONS

Communication Pursuant to Article 94(3) EPC, mailed Sep. 10, 2012, issued in related European Application No. 05810711, filed Dec. 1, 2005, 3 pages.
Communication Pursuant to Article 94(3) EPC, mailed Sep. 10, 2012, issued in related European Application No. 10166556, filed Dec. 1, 2005, 3 pages.
Communication Pursuant to Article 94(3) EPC, mailed Sep. 10, 2012, issued in related European Application No. 10184114, filed Dec. 1, 2005, 4 pages.
Communication Pursuant to Article 94(3) EPC, mailed Sep. 10, 2012, issued in related European Application No. 10184150, filed Dec. 1, 2005, 4 pages.
Office Action mailed Jul. 29, 2013, issued in related Mexican Application No. MX/a/2008/015227, filed Nov. 28, 2005, 7 pages.
Office Action mailed Jul. 31, 2014, issued in related Canadian Application No. 2588292, filed Dec. 1, 2005, 3 pages.
Communication Pursuant to Article 94(3) EPC, mailed Aug. 20, 2014, issued in related European Application No. 10184114, filed Dec. 1, 2005, 3 pages.
Communication Pursuant to Article 94(3) EPC, mailed Aug. 20, 2014, issued in related European Application No. 10184150, filed Dec. 1, 2005, 3 pages.
Patent Examination Report No. 2 mailed Oct. 2, 2014, issued in related Australian Application No. 2012201491, filed Mar. 13, 2012, 7 pages.
Mizuno, K., et al., "A New Family of Endogenous "Big" Met-Enkephalins from Bovine Adrenal Medulla: Purification and Structure of Docosa—(BAM-22P) and Eicosapeptide (BAM-20P) with Very Potent Opiate Activity," Biochemical and Biophysical Research Communications 97(4):1283-1290, Dec. 1980.
Blanke, S.R., et al., "Fused Polycationic Peptide Mediates Delivery of Diphtheria Toxin A Chain to the Cytosol in the Presence of Anthrax Protective Antigen," Proceedings of the National Academy of Sciences of the United States of America (PNAS) 93(16):8437-8442, Aug. 1996.
Blaustein, R.O., et al., "The N-Terminal Half of the Heavy Chain of Botulinum Type A Neurotoxin Forms Channels in Planar Phospholipid Bilayers," FEBS (Federation of European Biochemical Societies) Letters 226(1):115-120, Dec. 1987.
Kielian, M., et al., "Mechanisms of Mutations Inhibiting Fusion and Infection by Semliki Forest Virus," Journal of Cell Biology 134(4):863-872, Aug. 1996.
Kihara, A., and I. Pastan, "Analysis of Sequences Required for the Cytotoxic Action of a Chimeric Toxin Composed of Pseudomonas Exotoxin and Transforming Growth Factor α," Bioconjugate Chemistry 5(6):532-538, Nov. 1994.
Liu, H.-X., and T. Hökfelt, "The Participation of Galanin in Pain Processing at the Spinal Level," Trends in Pharmacological Sciences 23(10):468-474, Oct. 2002.
London, E., "Diphtheria Toxin: Membrane Interaction and Membrane Translocation," Biochimica et Biophysica Acta (BBA)—Reviews of Biomembranes 1113(1):25-51, Mar. 1992.
Murata, M., et al., "pH-Dependent Membrane Fusion and Vesiculation of Phospholipid Large Unilamellar Vesicles Induced by Amphiphilic Anionic and Cationic Peptides," Biochemistry 31(7):1986-1992, Feb. 1992.
O'Keefe, D.O., et al., "pH-Dependent Insertion of Proteins Into Membranes: B-Chain Mutation of Diphtheria Toxin That Inhibits Membrane Translocation, Glu-349→Lys," Proceedings of the National Academy of Sciences of the United States of America (PNAS) 89(13):6202-6206, Jul. 1992.
Picard-Maureau, M., et al., "Foamy Virus Envelope Glycoprotein-Mediated Entry Involves a pH-Dependent Fusion Process," Journal of Virology 77(8):4722-4730, Apr. 2003.
Pohlner, J., et al., "Gene Structure and Extracellular Secretion of Neisseria gonorrhoeae IgA Protease," Nature 325:458-462, Jan. 1987.
Prior, T.I., et al., "Translocation Mediated by Domain II of Pseudomonas Exotoxin A: Transport of Barnase Into the Cytosol," Biochemistry 31(14):3555-3559, Apr. 14, 1992.
Seth, S., et al., "Activation of Fusion by the SER Virus F Protein: A Low-pH-Dependent Paramyxovirus Entry Process," Journal of Virology 77(11):6520-6527, Jun. 2003.
Silverman, J.A., et al., "Mutational Analysis of the Helical Hairpin Region of Diphtheria Toxin Transmembrane Domain," Journal of Biological Chemistry 269(36):22524-22532, Sep. 1994.
Smith, D.K., et al., "Improved Amino Acid Flexibility Parameters," Protein Science 12(5):1060-1072, May 2003.
Yao, Y., et al., "Membrane Fusion Activity of Vesicular Stomatitis Virus Glycoprotein G is Induced by Low pH but Not by Heat or Denaturant," Virology 310(2):319-332, Jun. 2003.

(56) References Cited

OTHER PUBLICATIONS

Office Action mailed Oct. 29, 2013, issued in related Japanese Application No. 2011-258137, filed Nov. 25, 2011, 6 pages.
Patent Examination Report No. 2, mailed Nov. 7, 2013, issued in related Australian Application No. 2012203055, filed May 24, 2012, 3 pages.
Patent Examination Report No. 2, mailed Nov. 7, 2013, issued in related Australian Application No. 2012203056, filed May 24, 2012, 3 pages.
Crasto, C., and Feng, J., "Linker: a Program to Generate Linker Sequences for Fusion Proteins," Protein Engineering 13(5):309-312, May 2000.
International Search Report and Written Opinion mailed Dec. 20, 2013, issued in related International Application No. PCT/GB2013/052243, filed Aug. 27, 2013, 12 pages.
Blanc, J.P., et al., "Examination of the Requirement for an Amphiphilic Helical Structure in Beta-Endorphin Through the Design, Synthesis, and Study of Model Peptides," Journal of Biological Chemistry 258(13):8277-8284, Jul. 1983.
Chaddock, J.A., and K.A. Foster, "Manipulation of Signal Transduction by Botulinum Neurotoxins and Their Derivatives," Current Signal Transduction Therapy 2(3):221-225, Jan. 2007.
Chaddock, J.A., et al., "A Conjugate Composed of Nerve Growth Factor Coupled to a Non-Toxic Derivative of Clostridium botulinum Neurotoxin Type A Can Inhibit Neurotransmitter Release In Vitro," Growth Factors 18(2):147-155, Jan. 2000.
Chaddock, J.A., et al., "Expression and Purification of Catalytically Active, Non-Toxic Endopeptidase Derivatives of Clostridium botulinum Toxin Type A," Protein Expression and Purification 25(2):219-228, Jul. 2002.
Chaddock, J.A., et al., "Inhibition of Vesicular Secretion in Both Neuronal and Nonneuronal Cells by a Retargeted Endopeptidase Derivative of Clostridium botulinum Neurotoxin Type A," Infection and Immunity 68(5):2587-2593, May 2000.
Chaddock, J.A., et al., "Retargeted Clostridial Endopeptidases: Inhibition of Nociceptive Neurotransmitter Release In Vitro, and Antinociceptive Activity in In Vivo Models of Pain," Movement Disorders 19(Suppl 8):S42-S47, Mar. 2004; and in Naunyn-Schmiedeberg's Archives of Pharmacology 365(Suppl 2):R15, Jun. 2002.
Cui, M., et al., "Retargeted Clostridial Endopeptidase: Antinociceptive Activity in Preclinical Models of Pain," Naunyn-Schmiedeberg's Archives of Pharmacology:R16, Jun. 2002.
Dooley, C.T., et al., "Binding and In Vitro Activities of Peptides With High Affinity for the Nociceptin/Orphanin FQ Receptor, ORL1," Journal of Pharmacology and Experimental Therapy 283(2):735-741, Nov. 1997.
Duggan, M.J., et al., "Inhibition of Release of Neurotransmitters From Rat Dorsal Root Ganglia by a Novel Conjugate of a Clostridium botulinum Toxin A Endopeptidase Fragment and Erythrina cristagalli Lectin," Journal of Biological Chemistry 277(38):34846-34852, Sep. 2002.
Foster, K.A., et al., "Re-Engineering the Target Specificity of Clostridial Neurotoxins: A Route to Novel Therapeutics," Neurotoxicity Research 9(2,3):101-107, Apr. 2006.
Guerrini, R., et al., "Address and Message Sequences for the Nociceptin Receptor: A Structure—Activity Study of Nociceptin-(1-13)-Peptide Amide," Journal of Medicinal Chemistry 40(12):1789-1793, Jun. 1997.
Inoue, M., et al., "Nociceptin/Orphanin FQ-Induced Nociceptive Responses Through Substance P Release From Peripheral Nerve Endings in Mice," Proceedings of the National Academy of Sciences of the United States of America (PNAS) 95(18):10949-10953, Sep. 1998.
Maile, R., et al., "Effects of Nociceptin and Analogues of Nociceptin Upon Spontaneous Dorsal Root Activity Recorded From an In Vitro Preparation of Rat Spinal Cord," Neuroscience Letters 350(3):190-192, Oct. 2003.

Mogil, J.S., and G.W. Pasternak, "The Molecular and Behavioral Pharmacology of the Orphanin FQ/Nociceptin Peptide and Receptor Family," Pharmacological Review 53(3):381-415, Sep. 2001.
Okada, K., et al., "Highly Potent Nociceptin Analog Containing the Arg-Lys Triple Repeat," Biochemical and Biophysical Research Communications 278(2):493-498, Nov. 2000.
Plank, C., et al., "The Influence of Endosome-Disruptive Peptides on Gene Transfer Using Synthetic Virus-Like Gene Transfer Systems," Journal of Biological Chemistry 269(17):12918-12924, Apr. 1994.
Rizzi, D., et al., "[Arg(14),Lys(15)]Nociceptin, A Highly Potent Agonist of the Nociceptin/Orphanin FQ Receptor: In Vitro and In Vivo Studies," Journal of Pharmacology and Experimental Therapy 300(1):57-63, Jan. 2002.
Schiavo, G., et al., "Neurotoxins Affecting Neuroexocytosis," Physiological Reviews 80(2):717-766, Apr. 2000.
Shone, C.C., et al., "A 50-kDa Fragment From the NH2-Terminus of the Heavy Subunit of Clostridium botulinum Type A Neurotoxin Forms Channels in Lipid Vesicles," European Journal of Biochemistry 167(1):175-180, Aug. 1987.
Sutton, J. M., et al., "Preparation of Specifically Activatable Endopeptidase Derivatives of Clostridium botulinum Toxins Type A, B, and C and Their Applications," Protein Expression and Purification 40(1):31-41, Mar. 2005.
Turton, K., et al., "Botulinum and Tetanus Neurotoxins: Structure, Function and Therapeutic Utility," Trends in Biochemical Science 27(11):552-558, Nov. 2002.
Vergnolle, N., et al., "Proteinase-Activated Receptor-2 and Hyperalgesia: A Novel Pain Pathway," Nature Medicine 7(7):821-826, Jul. 2001.
Wagner, E., et al., "Influenza Virus Hemagglutinin HA-2 N-Terminal Fusogenic Peptides Augment Gene Transfer by Transferrin-Polylysine-DNA Complexes: Toward a Synthetic Virus-Like Gene-Transfer Vehicle," Proceedings of the National Academy of Sciences of the United States of America (PNAS) 89(17):7934-7938, Sep. 1992.
Xu, X.J., et al., "Galanin and Spinal Nociceptive Mechanisms: Recent Advances and Therapeutic Implications," Neuropeptides 34(3-4):137-147, Jun.-Aug. 2000.
International Search Report mailed Oct. 15, 2008, issued in corresponding International Application No. PCT/GB2007/002049, filed Jun. 1, 2007, 5 pages.
International Preliminary Report on Patentability issued Dec. 3, 2008, in corresponding International Application No. PCT/GB2007/002049, filed Jun. 1, 2007, 9 pages.
Office Action mailed Apr. 26, 2013, issued in related Canadian Application No. 2588292 filed Dec. 1, 2005, 3 pages.
Patent Examination Report No. 1 mailed Apr. 9, 2014, issued in related Australian Application No. 2011202219, filed May 13, 2011, 3 pages.
Patent Examination Report No. 1 mailed Apr. 9, 2014, issued in related Australian Application No. 2012200046, filed Jan. 5, 2012, 3 pages.
Patent Examination Report No. 1 mailed Apr. 9, 2014, issued in related Australian Application No. 2012201491, filed Mar. 13, 2012, 4 pages.
Office Action mailed May 20, 2014, issued in related Japanese Application No. 2012236094, filed Oct. 25, 2012, 18 pages.
Office Action mailed Mar. 10, 2014, issued in related Mexican Application No. MX/a/2008/015227, filed Nov. 28, 2005, 9 pages.
Office Action mailed Mar. 25, 2013, issued in related Chinese Application No. 200780028089.0 filed Jun. 1, 2007, 12 pages.
Patent Examination Report No. 1 mailed Apr. 13, 2015, issued in related Australian Application No. 2011202225, filed May 13, 2011, 3 pages.
Office Action mailed May 19, 2015, issued in related Japanese Application No. 2014-014941, filed Jan. 29, 2014, 7 pages.
Tachibana, S., and H. Yoshino, "Design and Synthesis of Metabolically Stable Analogue of Dynorphin-A," Journal of Synthetic Organic Chemistry, Japan 49(1):16-25, 1991.

* cited by examiner

Duration of action following eDRG exposure for 1 Day

| Parameters for MrgX1 receptor targeted chimaera: pEC50, % BAM (8-22) Emax and % BAM (8-22) Emax at 1 µM | | | |
|---|---|---|---|
| Construct | pEC50 | % BAM (8-22) Emax | % Emax at 1 µM |
| CPBAM1-22 | N/A | N/A | 81.93 ± 4.68 |
| CPBAM8-22 | 7.08 ± 0.24a | 108.25 ± 11.26 | N/R |
| CTBAM1-22 | 8.37 ± 0.20a | 108.58 ± 5.50 | N/R |
| CTBAM8-22 | N/A | N/A | 83.15 ± 9.08 |

Figure 36

Caspaicin Induced Thermal Hyperalgesia

| Fusion | Dose (i.pl) | Mean MPE ± SEM (n) |
|---|---|---|
| CPBAM1-22 | 25ng | 13.4 ± 0.6% (6) |
| CPBAM8-22 | 25ng | 26.2 ± 1.4% (6) |

Figure 37

Caspaicin Thermal Hyperalgesia Screen

| Fusion protein | $ED_{50}$ (ng/rat ± SEM) |
|---|---|
| BAM8-22 fusion | 127 ± 48.2 |
| B-endorphin fusion | 55.7 ± 21.7 |
| Substance P analogue 'S6' | 219.9 ± 82.8 |
| Dynorphin | 7.3 ± 3.6 |
| Nociceptin fusion | 164.7 ± 62.2 |

Figure 38

CPBE (Serotype A)

pK = 7.22 ± 0.03

| pIC$_{50}$ ± s.e. mean |
|---|
| 6.92 ± 0.04 |

CPBE (Serotype B)

| pIC$_{50}$ ± s.e. mean |
|---|
| 7.00 ± 0.02 |

CPBE (Serotype D)

| pIC$_{50}$ ± s.e. mean |
|---|
| 7.01 ± 0.01 |

CPBE fusion: Max cleavage 23%, $ED_{50}$ 38nm

Figure 40

Caspaicin Induced Paw Guarding Assay

| Fusion | Dose (i.pl) | % Inhibition ± SEM (n) |
|---|---|---|
| CPBE (serotype A) | 25ng | 27.1 ± 9.2 (6) |
| CPBE (serotype B) | 25ng | 24.5 ± 9.0% (6) |

Figure 41

Caspaicin Induced Thermal Hyperalgesia

| Fusion | Dose (i.pl) | MPE (%) |
|---|---|---|
| CPBE (serotype A) | 25ng | 18.7 ± 2.7 |
| CPBE (serotype B) | 25ng | 16.5 ± 2.3 |
| CPBE (serotype D) | 25ng | 38.2 ± 5.1 |

| Construct | Emax ± SEM | pEC$_{50}$ ± SEM | EC$_{50}$ (pM) | n$_H$ ± SEM |
|---|---|---|---|---|
| Bradykinin fusion | 119.32 ± 13.13 | -8.48 ± 0.17 | 3330 | 1.33 ± 0.34 |

Figure 43

Caspaicin Induced Paw Guarding Assay

| Fusion | Dose (i.pl) | % Inhibition ± SEM (n) |
|---|---|---|
| Bradykinin | 2.5ng | 4.7 ± 2.0 (5) |
| Bradykinin | 25ng | 12.2 ± 4.5% (6) |

Figure 44

Caspaicin Induced Thermal Hyperalgesia Assay

| Fusion | Dose (i.pl) | Mean MPE ± SEM (n) |
|---|---|---|
| Bradykinin | 25ng | 36.3 ± 1.1%(6) |

FUSION PROTEINS

CROSS-REFERENCES TO RELATED APPLICATIONS

This application is a continuation-in-part of U.S. application Ser. No. 12/303,078, filed Sep. 21, 2009, which is a National Stage of International Application No. PCT/GB2007/002049, filed Jun. 1, 2007, which claims priority of Application No. GB 0610867.4, filed Jun. 1, 2006, the disclosures of which are incorporated herein.

STATEMENT REGARDING SEQUENCE LISTING

The sequence listing associated with this application is provided in text format in lieu of a paper copy and is hereby incorporated by reference into the specification. The name of the text file containing the sequence listing is 39083_SEQ_FINAL_2012-03-09.txt. The text file is 763 KB; was created on Mar. 9, 2012; and is being submitted via EFS-Web with the filing of the specification.

FIELD OF THE INVENTION

This invention relates to non-cytotoxic fusion proteins and to the therapeutic application thereof as analgesic molecules.

BACKGROUND

Toxins may be generally divided into two groups according to the type of effect that they have on a target cell. In more detail, the first group of toxins kill their natural target cells, and are therefore known as cytotoxic toxin molecules. This group of toxins is exemplified inter alia by plant toxins such as ricin, and abrin, and by bacterial toxins such as diphtheria toxin, and *Pseudomonas* exotoxin A. Cytotoxic toxins have attracted much interest in the design of "magic bullets" (e.g., immunoconjugates, which comprise a cytotoxic toxin component and an antibody that binds to a specific marker on a target cell) for the treatment of cellular disorders and conditions such as cancer. Cytotoxic toxins typically kill their target cells by inhibiting the cellular process of protein synthesis.

The second group of toxins, which are known as non-cytotoxic toxins, do not (as their name confirms) kill their natural target cells. Non-cytotoxic toxins have attracted much less commercial interest than have their cytotoxic counterparts, and exert their effects on a target cell by inhibiting cellular processes other than protein synthesis. Non-cytotoxic toxins are produced by a variety of plants, and by a variety of microorganisms such as *Clostridium* sp. and *Neisseria* sp.

Clostridial neurotoxins are proteins that typically have a molecular mass of the order of 150 kDa. They are produced by various species of bacteria, especially of the genus *Clostridium*, most importantly *C. tetani* and several strains of *C. botulinum*, *C. butyricum* and *C. argentinense*. There are at present eight different classes of the clostridial neurotoxin, namely: tetanus toxin, and botulinum neurotoxin in its serotypes A, B, C1, D, E, F and G, and they all share similar structures and modes of action.

Clostridial neurotoxins represent a major group of non-cytotoxic toxin molecules, and are synthesised by the host bacterium as single polypeptides that are modified post-translationally by a proteolytic cleavage event to form two polypeptide chains joined together by a disulphide bond. The two chains are termed the heavy chain (H-chain), which has a molecular mass of approximately 100 kDa, and the light chain (L-chain), which has a molecular mass of approximately 50 kDa.

L-chains possess a protease function (zinc-dependent endopeptidase activity) and exhibit a high substrate specificity for vesicle and/or plasma membrane associated proteins involved in the exocytic process. L-chains from different clostridial species or serotypes may hydrolyse different but specific peptide bonds in one of three substrate proteins, namely synaptobrevin, syntaxin or SNAP-25. These substrates are important components of the neurosecretory machinery.

*Neisseria* sp., most importantly from the species *N. gonorrhoeae*, produce functionally similar non-cytotoxic proteases. An example of such a protease is IgA protease (see WO99/58571).

It has been well documented in the art that toxin molecules may be re-targeted to a cell that is not the toxin's natural target cell. When so re-targeted, the modified toxin is capable of binding to a desired target cell and, following subsequent translocation into the cytosol, is capable of exerting its effect on the target cell. Said re-targeting is achieved by replacing the natural Targeting Moiety (TM) of the toxin with a different TM. In this regard, the TM is selected so that it will bind to a desired target cell, and allow subsequent passage of the modified toxin into an endosome within the target cell. The modified toxin also comprises a translocation domain to enable entry of the non-cytotoxic protease into the cell cytosol. The translocation domain can be the natural translocation domain of the toxin or it can be a different translocation domain obtained from a microbial protein with translocation activity.

The above-mentioned TM replacement may be effected by conventional chemical conjugation techniques, which are well known to a skilled person. In this regard, reference is made to Hermanson, G. T. (1996), *Bioconjugate techniques*, Academic Press, and to Wong, S. S. (1991), Chemistry of protein conjugation and cross-linking, CRC Press. Alternatively, recombinant techniques may be employed, such as those described in WO98/07864.

Pain-sensing cells possess a wide range of receptor types. However, not all receptor types are suited (least of all desirable) for receptor-mediated endocytosis. Similarly, binding properties can vary widely between different TMs for the same receptor, and even more so between different TMs and different receptors.

There is therefore a need to develop modified non-cytotoxic fusion proteins that address one or more of the above problems. Of particular interest is the development of an alternative/improved non-cytotoxic fusion protein for use in treating pain.

The present invention seeks to address one or more of the above problems by providing unique fusion proteins. In one embodiment, the Targeting Moiety (TM) component employed with a fusion protein of the present invention is an "agonist" of a receptor that is present on the pain-sensing target cell of interest. In one embodiment, the pain-sensing target cell is a nociceptive sensory afferent, for example a primary nociceptive sensory afferent.

SUMMARY

This summary is provided to introduce a selection of concepts in a simplified form that are further described below in the Detailed Description. This summary is not intended to identify key features of the claimed subject matter, nor is it intended to be used as an aid in determining the scope of the claimed subject matter.

The present invention addresses one or more of the above-mentioned problems by providing a single chain, polypeptide fusion protein, comprising:

a. a non-cytotoxic protease, or a fragment thereof, which protease or protease fragment is capable of cleaving a protein of the exocytic fusion apparatus in a nociceptive sensory afferent;

b. a Targeting Moiety that is capable of binding to a Binding Site on the nociceptive sensory afferent, which Binding Site is capable of undergoing endocytosis to be incorporated into an endosome within the nociceptive sensory afferent;

c. a protease cleavage site at which site the fusion protein is cleavable by a protease, wherein the protease cleavage site is located between the non-cytotoxic protease or fragment thereof and the Targeting Moiety; and d. a translocation domain that is capable of translocating the protease or protease fragment from within an endosome, across the endosomal membrane and into the cytosol of the nociceptive sensory afferent.

DESCRIPTION OF THE DRAWINGS

The foregoing aspects and many of the attendant advantages of this invention will become more readily appreciated as the same become better understood by reference to the following detailed description, when taken in conjunction with the accompanying drawings, wherein.

Using the methodology outlined in Example 9, a LC/A-nociceptin-HN/A fusion protein was purified from *E. coli* BL21 cells. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE (Panel A) and Western blotting (Panel B). Anti-nociceptin antisera (obtained from Abcam) were used as the primary antibody for Western blotting. The final purified material in the absence and presence of reducing agent is identified in the lanes marked (−) and (+) respectively.

Figure 1:
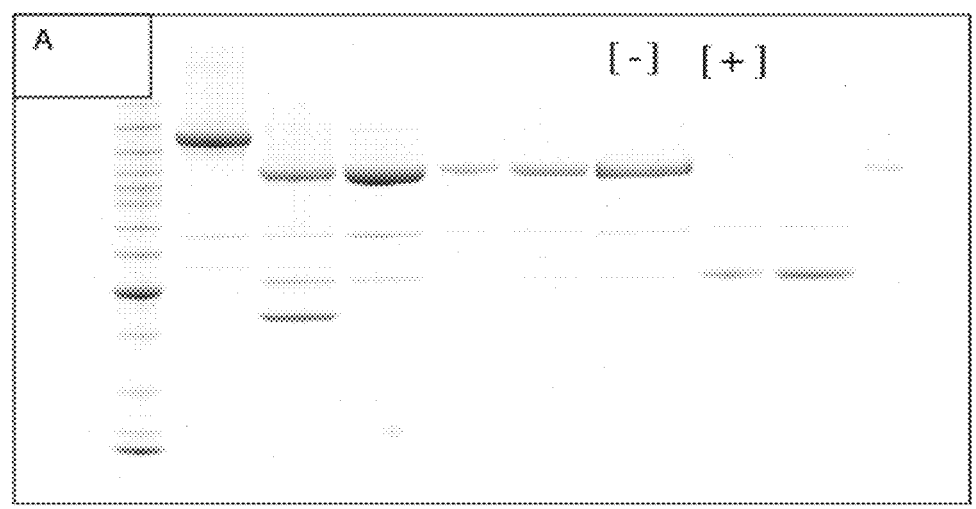
FIG. 1—Purification of a LC/A-nociceptin-$H_N$/A Fusion Protein
Figure 1:
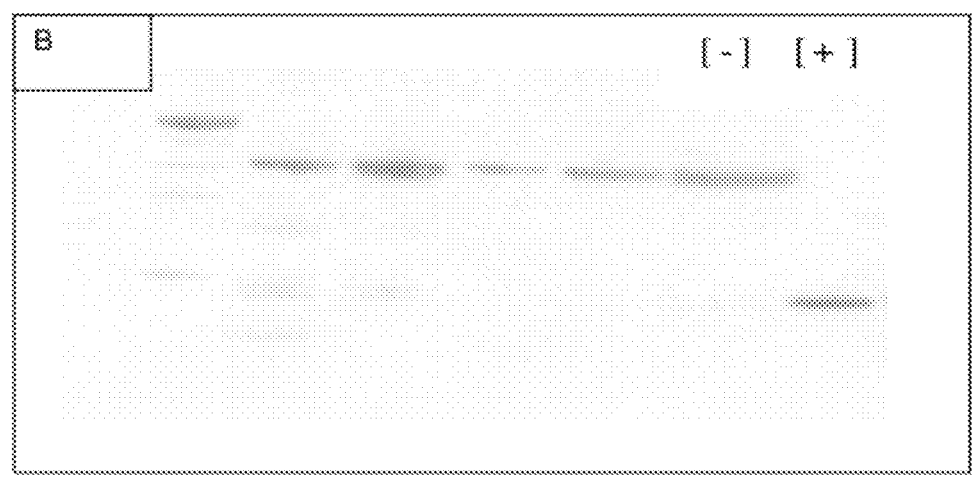
Figure 2:
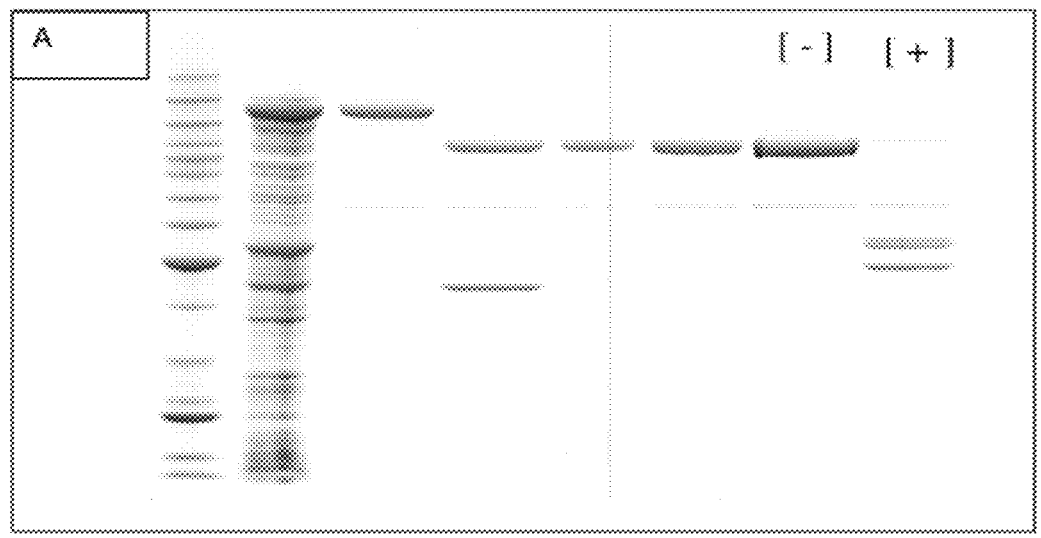
Figure 2:
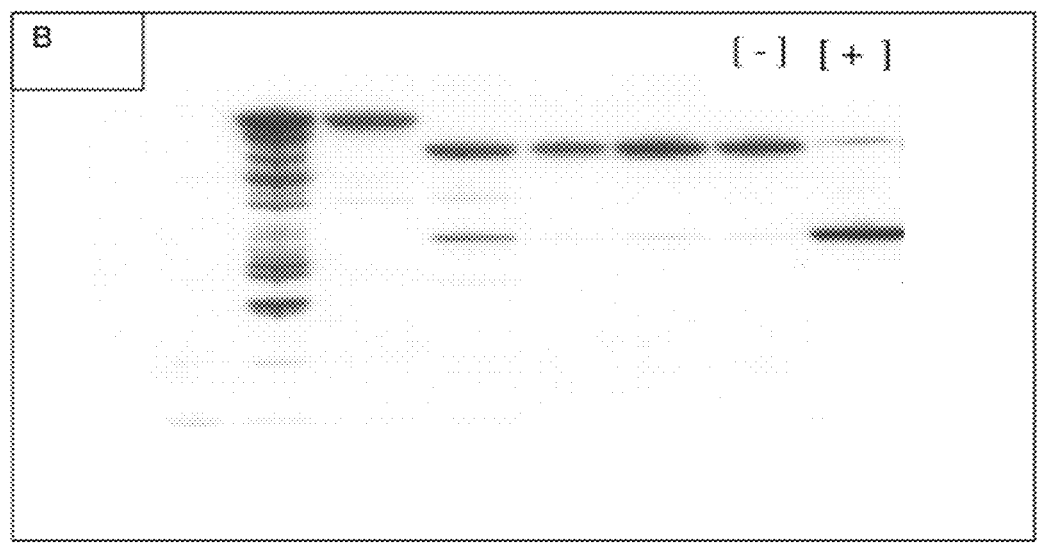

FIG. 2—Purification of a nociceptin-LC/A-$H_N$/A Fusion Protein

Using the methodology outlined in Example 9, a nociceptin-LC/A-$H_N$/A fusion protein was purified from *E. coli* BL21 cells. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE (Panel A) and Western blotting (Panel B). Anti-nociceptin antisera (obtained from Abcam) were used as the primary antibody for Western blotting. The final purified material in the absence and presence of reducing agent is identified in the lanes marked (−) and (+) respectively.

Figure 3:
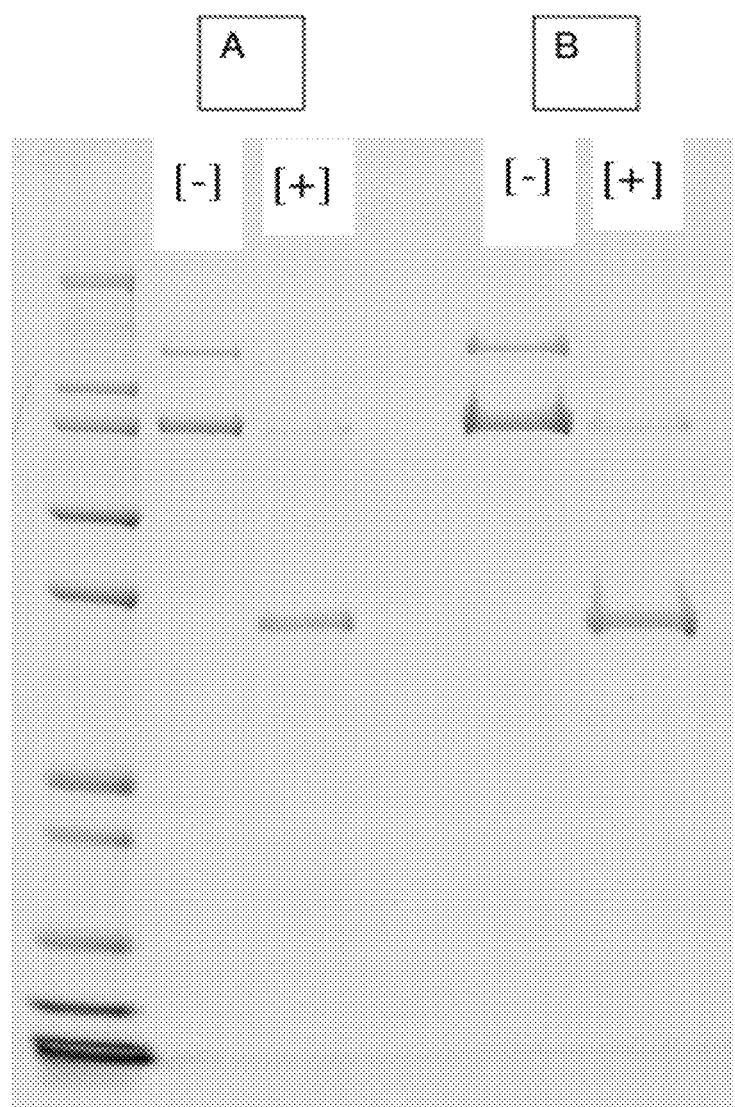

FIG. 3—Purification of a LC/C-nociceptin-$H_N$/C Fusion Protein

Using the methodology outlined in Example 9, an LC/C-nociceptin-$H_N$/C fusion protein was purified from *E. coli* BL21 cells. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE (Panel A) and Western blotting (Panel B). Anti-nociceptin antisera (obtained from Abcam) were used as the primary antibody for Western blotting. The final purified material in the absence and presence of reducing agent is identified in the lanes marked (−) and (+) respectively.

Figure 4:
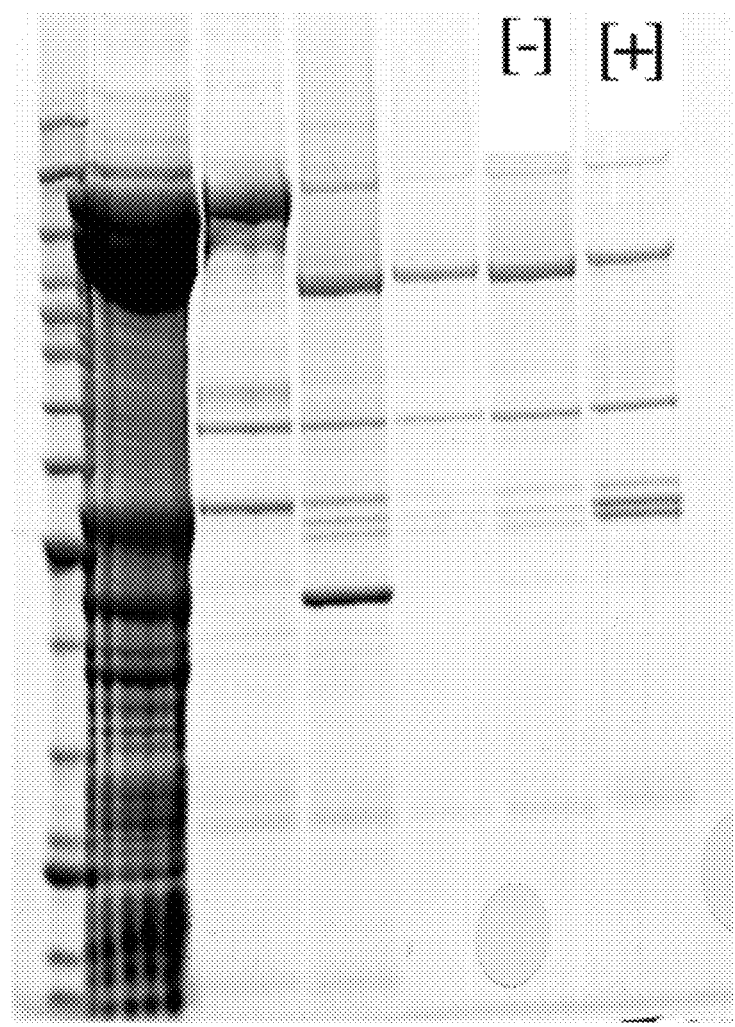

FIG. 4—Purification of a LC/A-met enkephalin-$H_N$/A Fusion Protein

Using the methodology outlined in Example 9, an LC/A-met enkephalin-$H_N$/A fusion protein was purified from *E. coli* BL21 cells. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE. The final purified material in the absence and presence of reducing agent is identified in the lanes marked (−) and (+) respectively.

Figure 5:
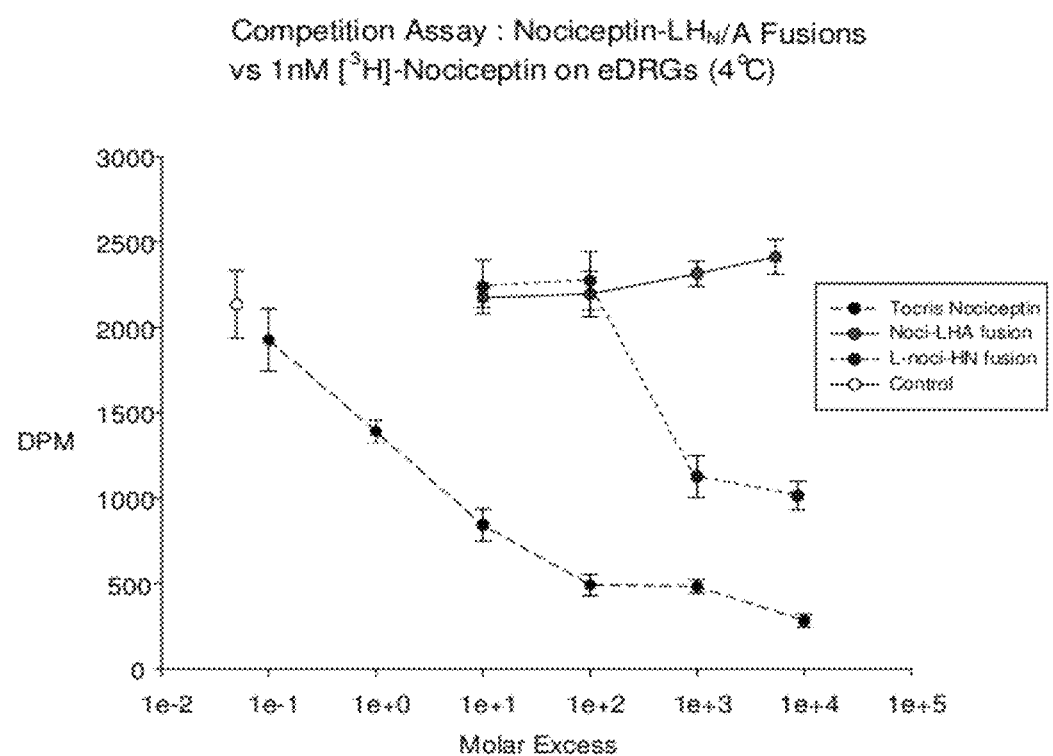

FIG. 5—Comparison of Binding Efficacy of a LC/A-nociceptin-$H_N$/A Fusion Protein and a nociceptin-LC/A-$H_N$/A Fusion Protein The ability of nociceptin fusions to bind to the $ORL_1$ receptor was assessed using a simple competition-based assay. Primary cultures of dorsal root ganglia (DRG) were exposed to varying concentrations of test material in the presence of 1 nM [$^3$H]-nociceptin. The reduction in specific binding of the radiolabelled ligand was assessed by scintillation counting, and plotted in comparison to the efficacy of unlabelled ligand (Tocris nociceptin). It is clear that the LC/A-nociceptin-$H_N$/A fusion is far superior to the nociceptin-LC/A-$H_N$/A fusion at interacting with the $ORL_1$ receptor.

Figure 6:
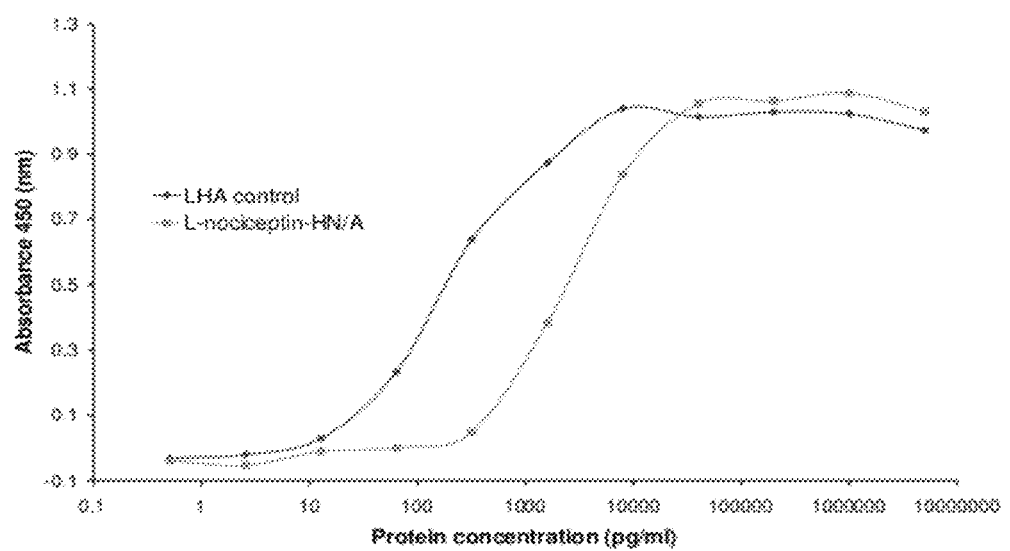

FIG. 6—In Vitro Catalytic Activity of a LC/A-nociceptin-$H_N$/A Fusion Protein

The in vitro endopeptidase activity of the purified LC/A-nociceptin-$H_N$/A fusion protein was determined essentially as described in Chaddock et al. 2002, *Prot. Express Purif.* 25:219-228. Briefly, SNAP-25 peptide immobilised to an ELISA plate was exposed to varying concentrations of fusion protein for 1 hour at 37° C. Following a series of washes, the amount of cleaved SNAP-25 peptide was quantified by reactivity with a specific antisera.

Figure 7:
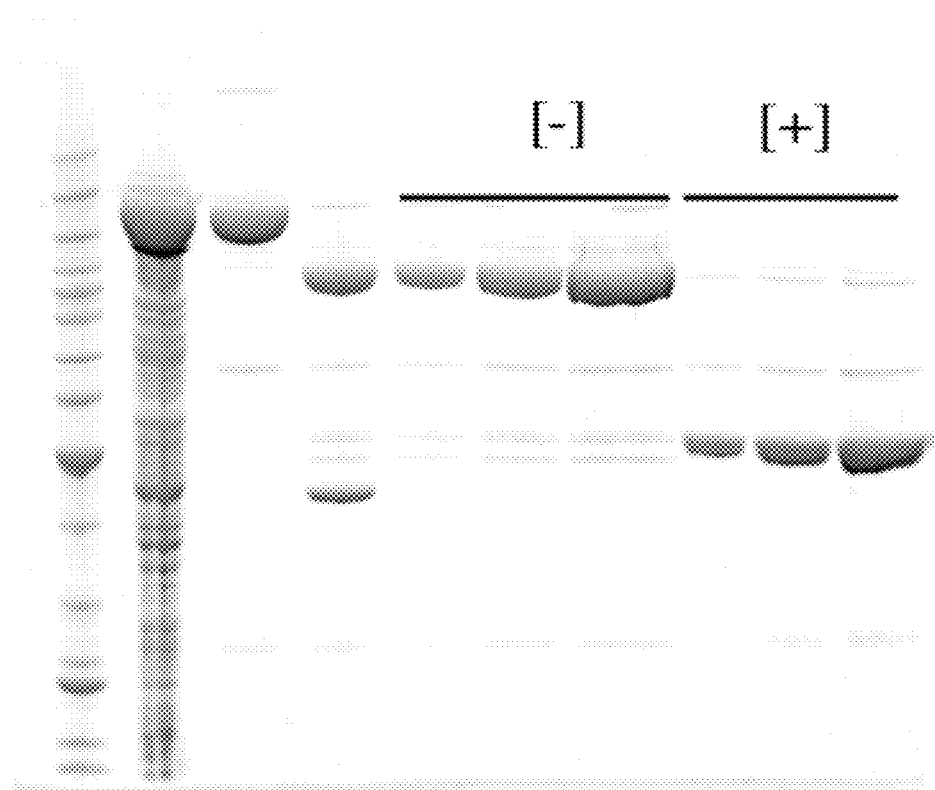

FIG. 7—Purification of a LC/A-nociceptin variant-$H_N$/A Fusion Protein

Using the methodology outlined in Example 9, an LC/A-nociceptin variant-$H_N$/A fusion protein was purified from *E. coli* BL21 cells. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE. The final purified material in the absence and presence of reducing agent is identified in the lanes marked (−) and (+) respectively.

Figure 8:
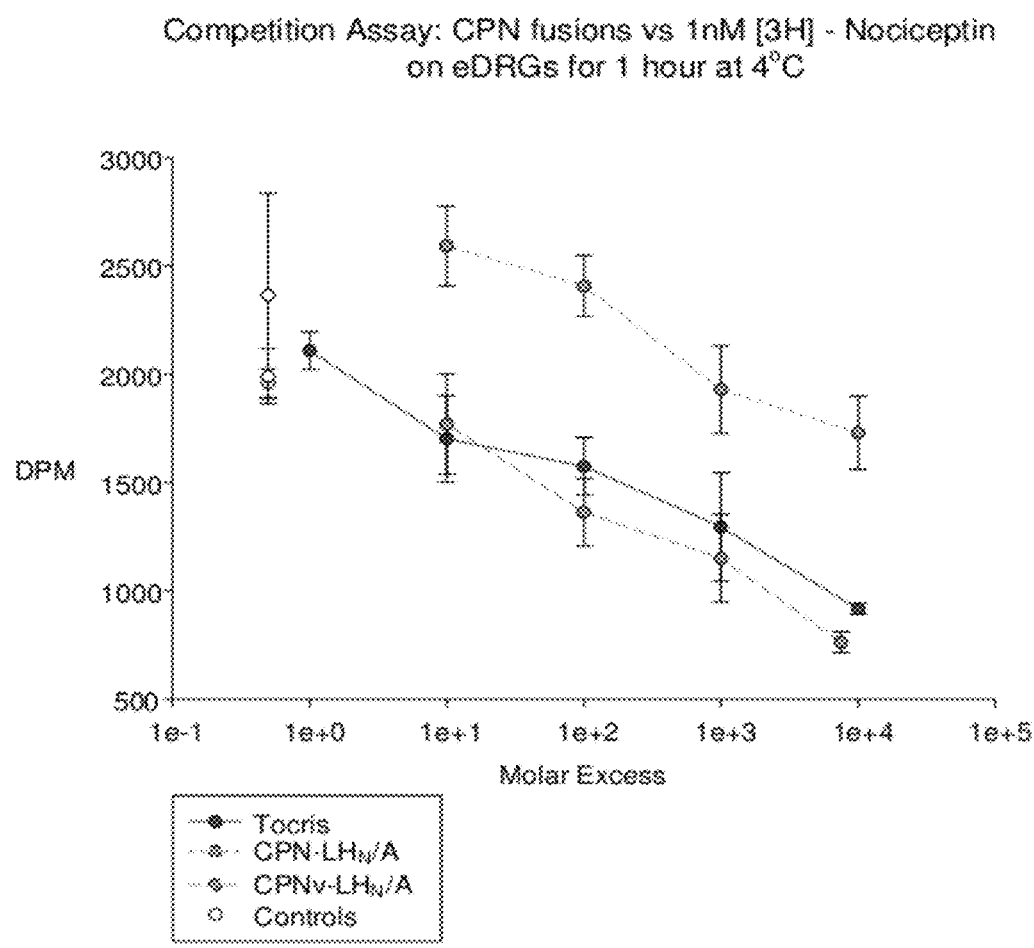

FIG. 8—Comparison of Binding Efficacy of a LC/A-nociceptin-$H_N$/A Fusion Protein and a LC/A-nociceptin variant-$H_N$/A Fusion Protein The ability of nociceptin fusions to bind to the $ORL_1$ receptor was assessed using a simple competition-based assay.

Primary cultures of dorsal root ganglia (DRG) were exposed to varying concentrations of test material in the presence of 1 nM [$^3$H]-nociceptin. The reduction in specific binding of the radiolabelled ligand was assessed by scintillation counting, and plotted in comparison to the efficacy of unlabelled ligand (Tocris nociceptin). It is clear that the LC/A-nociceptin variant-$H_N$/A fusion (CPNv-LHA) is superior to the LC/A-nociceptin variant-$H_N$/A fusion (CPN-LHA) at interacting with the $ORL_1$ receptor.

Figure 9:
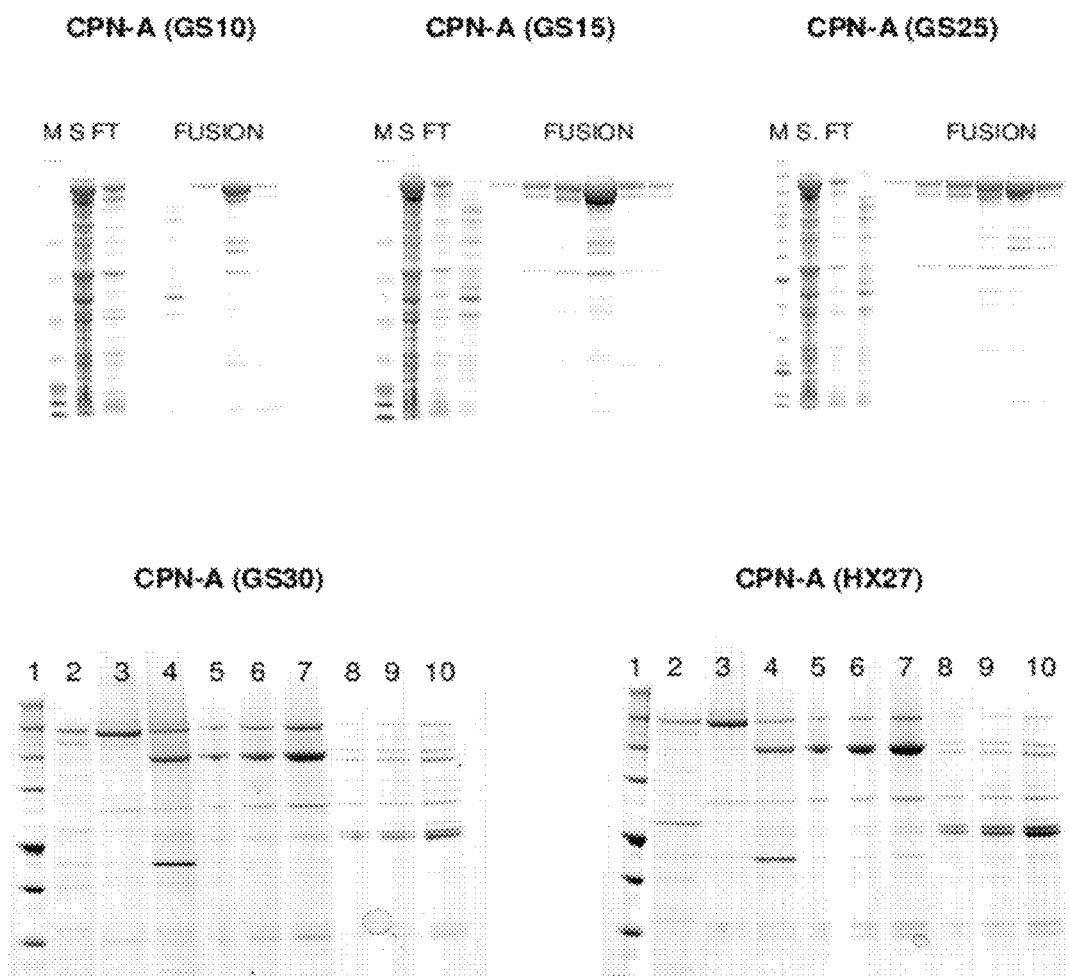

FIG. 9—Expressed/Purified LC/A-nociceptin-$H_N$/A Fusion Protein Family with Variable Spacer Length Product(s)

Using the methodology outlined in Example 9, variants of the LC/A-CPN-$H_N$/A fusion consisting of GS10, GS30 and Hx27 are purified from *E. coli* cell paste. Samples from the purification of LC/A-CPN(GS10)-$H_N$/A, LC/A-CPN (GS15)-$H_N$/A, LC/A-CPN(GS25)-$H_N$/A, LC/A-CPN (GS30)-$H_N$/A and LC/A-CPN(Hx27)-$H_N$/A were assessed by SDS-PAGE prior to staining with Coomassie Blue. The electrophoresis profile indicates purification of a disulphide-bonded di-chain species of the expected molecular mass of CPBE-A. Top panel: M=benchmark molecular mass markers; S=total *E. coli* protein soluble fraction; FT=proteins that did not bind to the $Ni^{2+}$-charged Sepharose column; FUSION=fusion protein eluted by the addition of imidazole. Bottom panel: Lane 1=benchmark molecular mass markers; Lane 2=total *E. coli* protein soluble fraction; Lane 3=purified material following initial capture on $Ni^{2+}$-charged Sepharose; Lane 4=Factor Xa treated material prior to final capture on $Ni^{2+}$-charged Sepharose; Lane 5=purified final material post activation with Factor Xa (5 µl); Lane 6=purified final material post activation with Factor Xa (10 µl); Lane 7=purified final material post activation with Factor Xa (20 µl); Lane 8=purified final material post activation with Factor Xa+DTT (5 µl); Lane 9=purified final material post activation with Factor Xa+DTT (10 µl); Lane 10=purified final material post activation with Factor Xa+DTT (20 µl).

Figure 10:
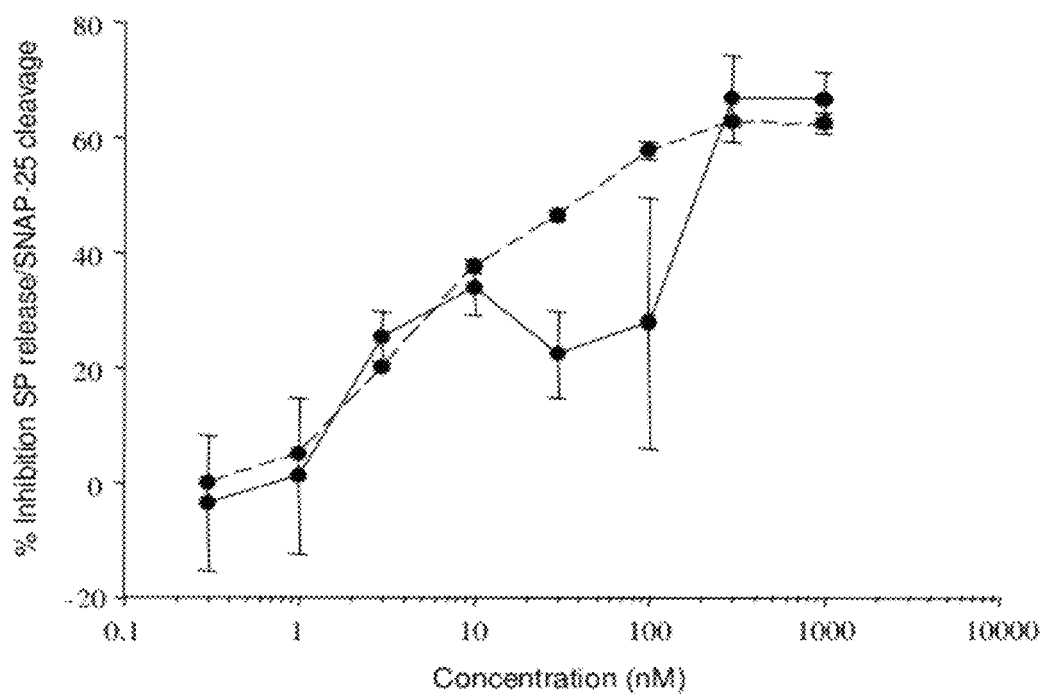

FIG. 10—Inhibition of SP Release and Cleavage of SNAP-25 by CPN-A

Briefly, primary cultures of dorsal root ganglia (DRG) were exposed to varying concentrations of CPN-A for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis and plotted against fusion concentration (dashed line). Material was also recovered for an analysis of substance P content using a specific EIA kit. Inhibition of substance P release is illustrated by the solid line. The fusion concentration required to achieve 50% maximal SNAP-25 cleavage is estimated to be 6.30±2.48 nM.

Figure 11:
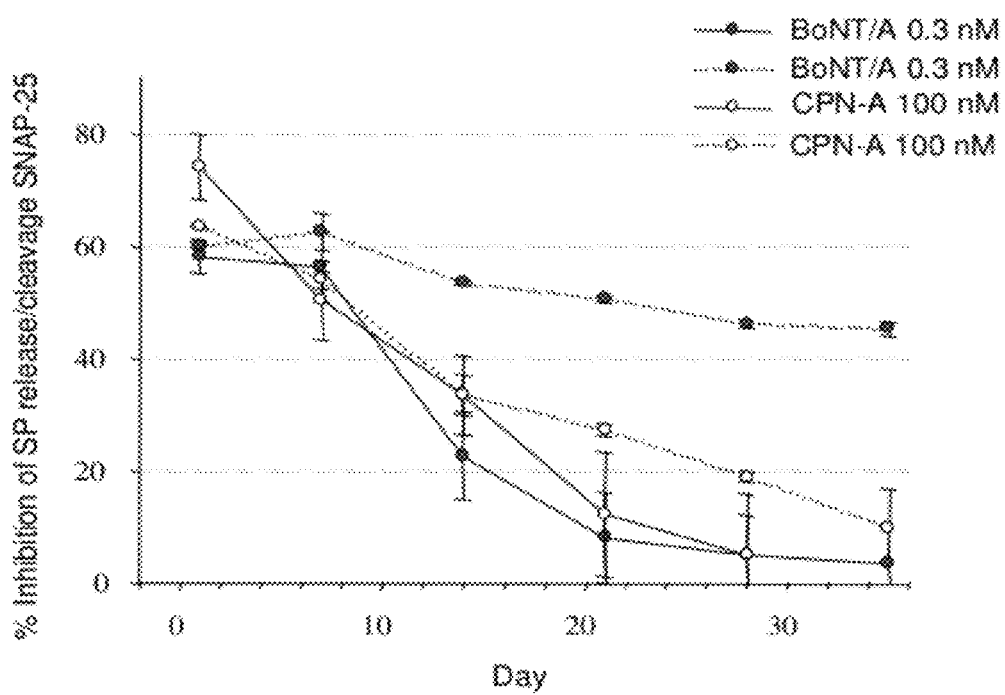

FIG. 11—Inhibition of SP Release and Cleavage of SNAP-25 Over Extended Time Periods After Exposure of DRG to CPN-A Primary cultures of dorsal root ganglia (DRG) were exposed to varying concentrations of CPN-A for 24 hours. Botulinum neurotoxin (BoNT/A) was used as a control. After this initial exposure, extracellular material was removed by washing, and the cells incubated at 37° C. for varying periods of time. At specific time points, cellular proteins were separated by SDS-PAGE, Western blotted, and probed with anti-SNAP-25 to facilitate an assessment of SNAP-25 cleavage. The percentage of cleaved SNAP-25 was calculated by densitometric analysis and illustrated by the dotted lines. Material was also recovered for an analysis of substance P content using a specific EIA kit. Inhibition of substance P release is illustrated by the solid lines.

Figure 12:
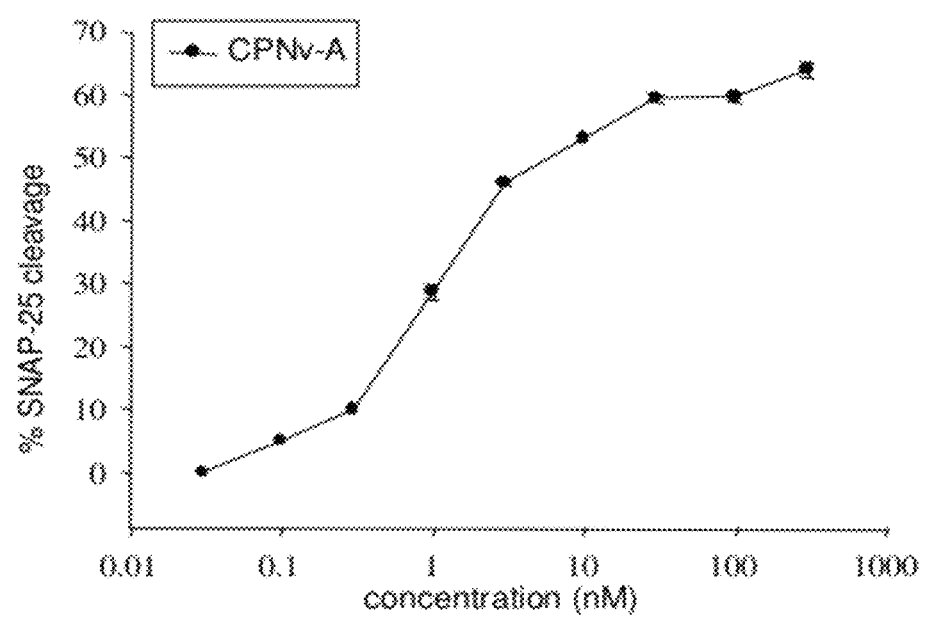

FIG. 12—Cleavage of SNAP-25 by CPNv-A

Primary cultures of dorsal root ganglia (DRG) were exposed to varying concentrations of CPNv-A for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. The fusion concentration required to achieve 50% maximal SNAP-25 cleavage is estimated to be 1.38±0.36 nM.

Figure 13:
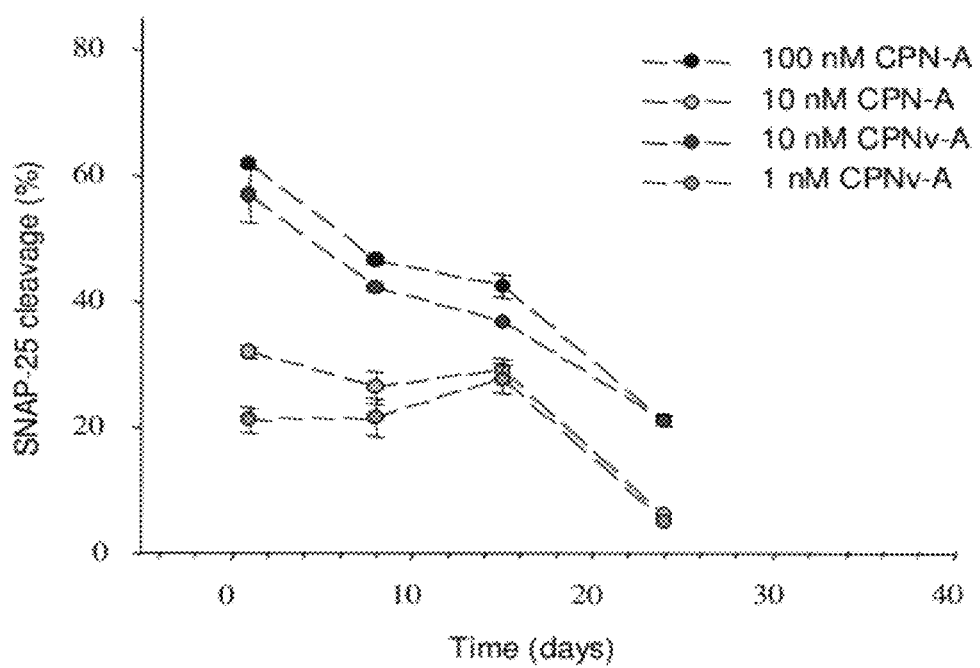

FIG. 13—Cleavage of SNAP-25 Over Extended Time Periods After Exposure of DRG to CPNv-A Primary cultures of dorsal root ganglia (DRG) were exposed to varying concentrations of CPNv-A for 24 hours. CPN-A was used as a control. After this initial exposure, extracellular material was removed by washing, and the cells incubated at 37° C. for varying periods of time. At specific time points, cellular proteins were separated by SDS-PAGE, Western blotted, and probed with anti-SNAP-25 to facilitate an assessment of SNAP-25 cleavage. The percentage of cleaved SNAP-25 was calculated by densitometric analysis.

Figure 14:
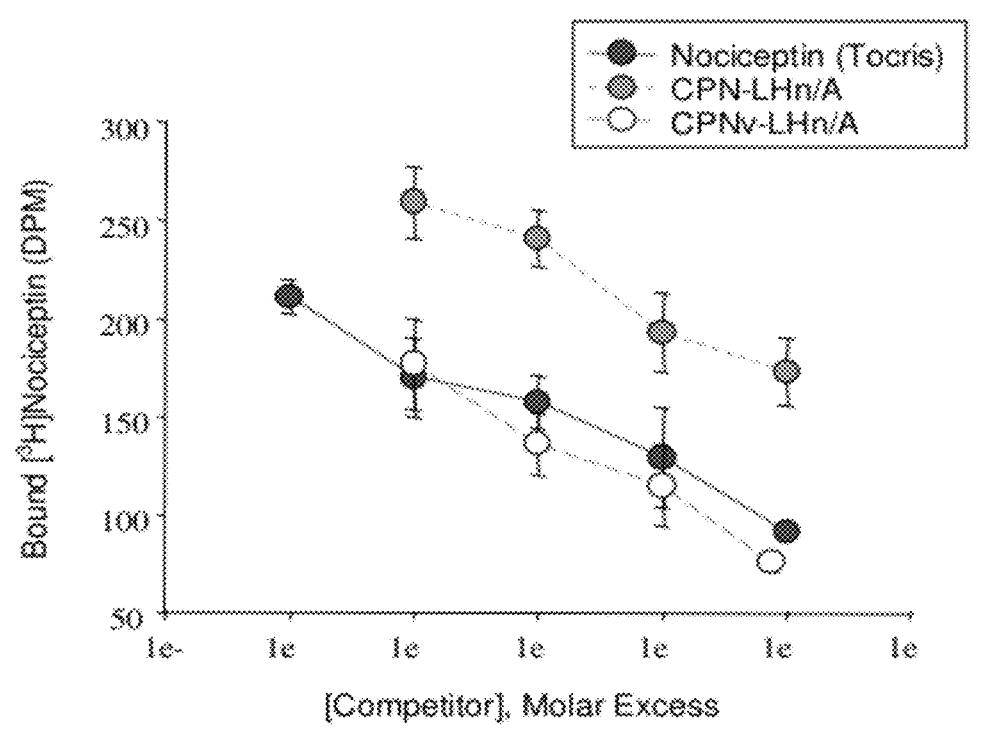

FIG. 14—CPNv-A Fusion-Mediated Displacement of [$^3$H]-nociceptin Binding

The ability of nociceptin fusions to bind to the $ORL_1$ receptor was assessed using a simple competition-based assay. Primary cultures of dorsal root ganglia (DRG) were exposed to varying concentrations of test material in the presence of 1 nM [$^3$H]-nociceptin. The reduction in specific binding of the radiolabelled ligand was assessed by scintillation counting, and plotted in comparison to the efficacy of unlabelled ligand (Tocris nociceptin). It is clear that the LC/A-nociceptin variant-$H_N$/A fusion (labelled as CPNv-LHnA) is superior to the LC/A-nociceptin-$H_N$/A fusion (labelled as CPN-LHnA) at interacting with the $ORL_1$ receptor.

Figure 15:
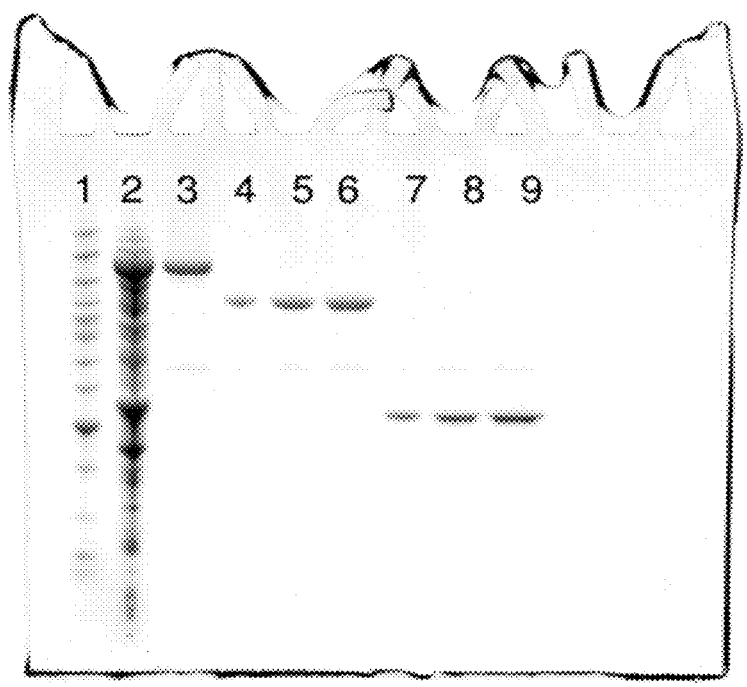

FIG. 15—Expressed/Purified CPNv(EK)-A Product

Proteins were subjected to SDS-PAGE prior to staining with Coomassie Blue. The electrophoresis profile indicates purification of a disulphide-bonded di-chain species of the expected molecular mass of CPNv(Ek)-A. Lane 1=benchmark molecular mass markers; Lane 2=total *E. coli* protein soluble fraction; Lane 3=purified material following initial capture on $Ni^{2+}$-charged Sepharose; Lane 4=purified final material post activation with enterokinase (5 µl); Lane 5=purified final material post activation with enterokinase (10 µl); Lane 6=purified final material post activation with enterokinase (20 µl); Lane 7=purified final material post activation with enterokinase+DTT (5 µl); Lane 8=purified final material post activation with enterokinase+DTT (10 µl); Lane 9=purified final material post activation with enterokinase+DTT (20 µl).

Figure 16:
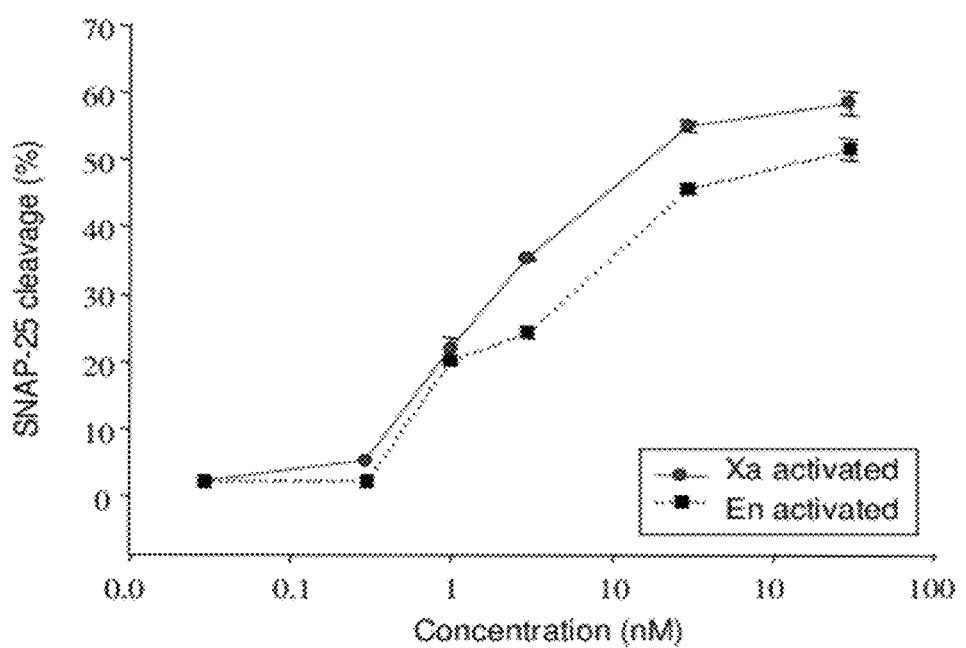

FIG. 16—Cleavage of SNAP-25 by CPNv(EK)-A

Primary cultures of dorsal root ganglia (DRG) were exposed to varying concentrations of CPNv(Ek)-A for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. CPNv-A as prepared in Example 9 was used for comparison purposes. The percentage cleavage of SNAP-25 by CPNv(Ek)-A (labelled as En activated) and CPNv-A (labelled as Xa activated) are illustrated.

Figure 17:
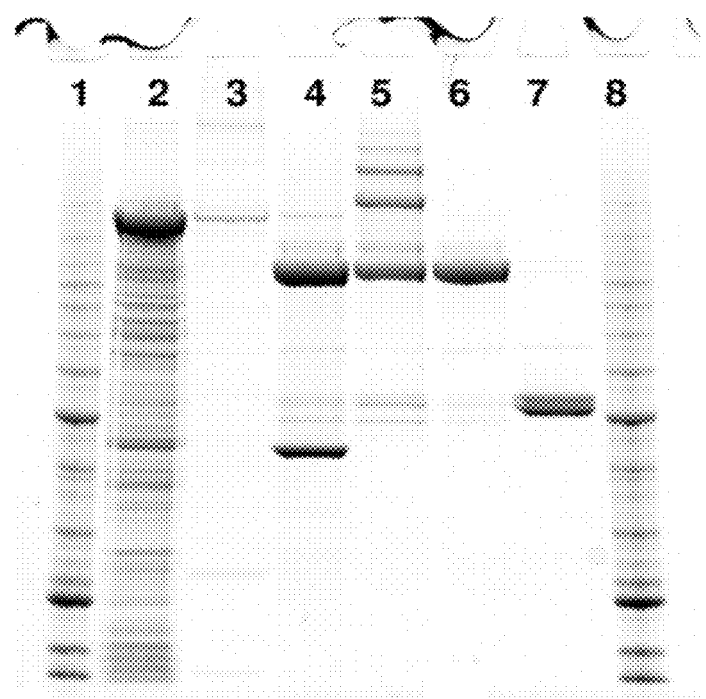

FIG. 17—Expressed/Purified CPNv-C Product

Proteins were subjected to SDS-PAGE prior to staining with Coomassie Blue. The electrophoresis profile indicates purification of a disulphide-bonded di-chain species of the expected molecular mass of CPNv-C. Lane 1=benchmark molecular mass markers; Lane 2=total *E. coli* protein soluble fraction; Lane 3=purified material following initial capture on Ni²⁺-charged Sepharose; Lane 4=Factor Xa treated material prior to final capture on Ni²⁺-charged Sepharose; Lane 5=purified material following second capture on Ni²⁺-charged Sepharose; Lane 6=final purified material; Lane 7=final purified material+DTT; Lane 8=benchmark molecular mass markers.

Figure 18:
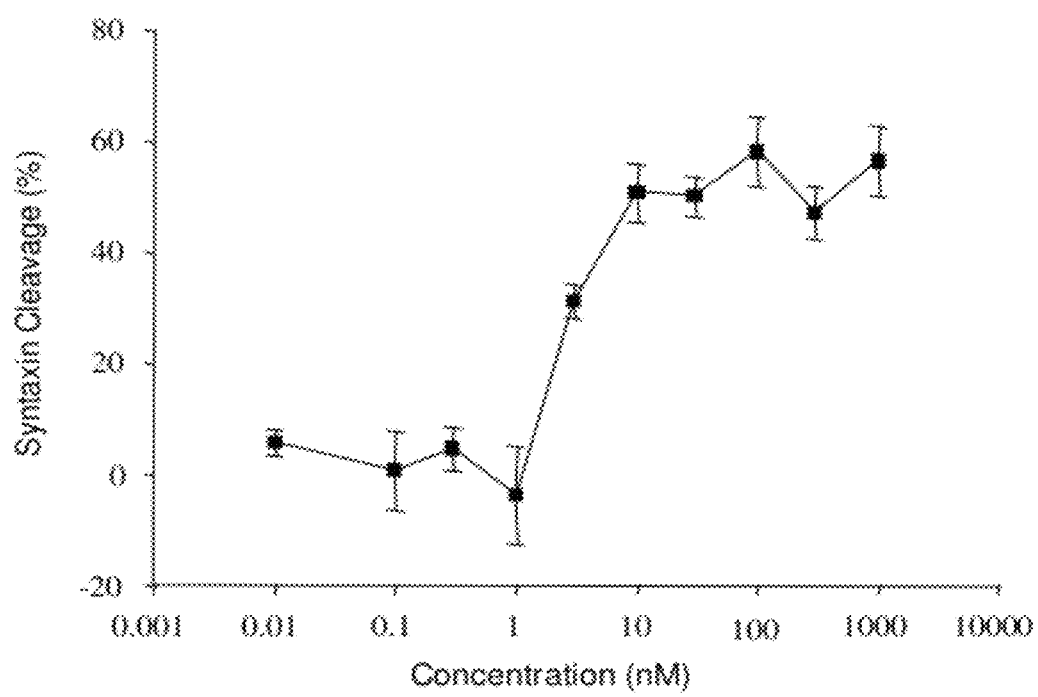

FIG. 18—Cleavage of SYNTAXIN by CPNv-C

Primary cultures of dorsal root ganglia (DRG) were exposed to varying concentrations of CPNv-C for 24 hours. Cellular proteins were separated by SDS-PAGE, Western blotted, and probed with anti-syntaxin to facilitate an assessment of syntaxin cleavage. The percentage of cleaved syntaxin was calculated by densitometric analysis. The fusion concentration required to achieve 50% maximal syntaxin cleavage is estimated to be 3.13±1.96 nM.

Figure 19:
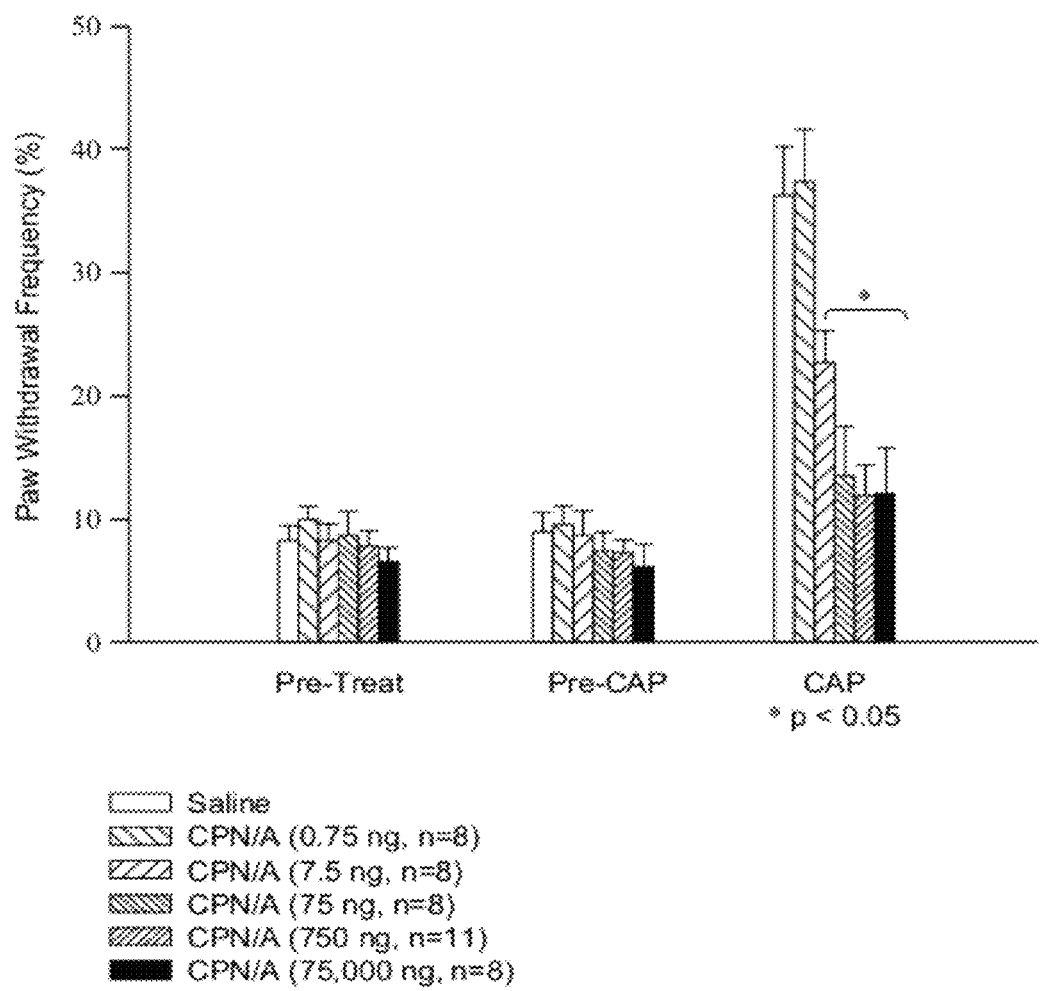

FIG. 19—CPN-A Efficacy in the Acute Capsaicin-Induced Mechanical Allodynia Model The ability of an LC/A-nociceptin-$H_N$/A fusion (CPN/A) to inhibit capsaicin-induced mechanical allodynia was evaluated following subcutaneous intraplantar injection in the rat hind paw. Test animals were evaluated for paw withdrawal frequency (PWF %) in response to a 10 g Von Frey filament stimulus series (10 stimuli×3 trials) prior to recruitment into the study (Pre-Treat); after subcutaneous intraplantar treatment with CPN/A but before capsaicin (Pre-CAP); and following capsaicin challenge post-injection of CPN/A (average of responses at 15' and 30'; CAP). Capsaicin challenge was achieved by injection of 10 µl of a 0.3% solution. Sample dilutions were prepared in 0.5% BSA/saline.

Figure 20:
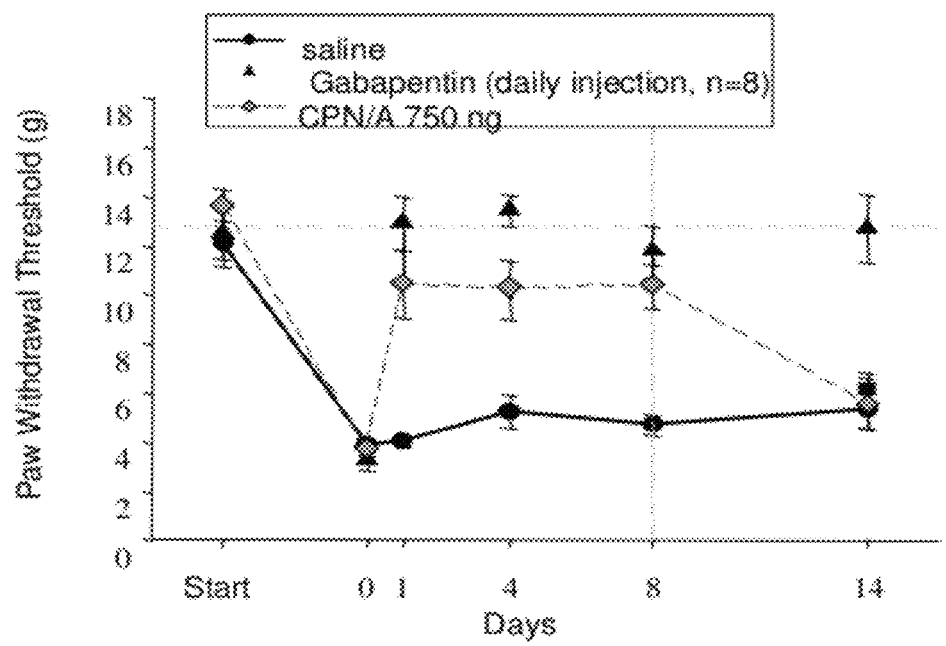

FIG. 20—CPN-A Efficacy in the Streptozotocin (STZ)-Induced Peripheral Diabetic Neuropathy (Neuropathic Pain) Model Male Sprague-Dawley rats (250-300 g) are treated with 65 mg/kg STZ in citrate buffer (I.V.) and blood glucose and lipid are measured weekly to define the readiness of the model. Paw Withdrawal Threshold (PWT) is measured in response to a Von Frey filament stimulus series over a period of time. Allodynia is said to be established when the PWT on two consecutive test dates (separated by 1 week) measures below 6 g on the scale. At this point, rats are randomized to either a saline group (negative efficacy control), gabapentin group (positive efficacy control) or a test group (CPN/A). Test materials (20-25 µl) are injected subcutaneously as a single injection (except gabapentin) and the PWT is measured at 1 day post-treatment and periodically thereafter over a 2 week period. Gabapentin (30 mg/kg i.p. @ 3 ml/kg injection volume) is injected daily, 2 hours prior to the start of PWT testing.

Figure 21:
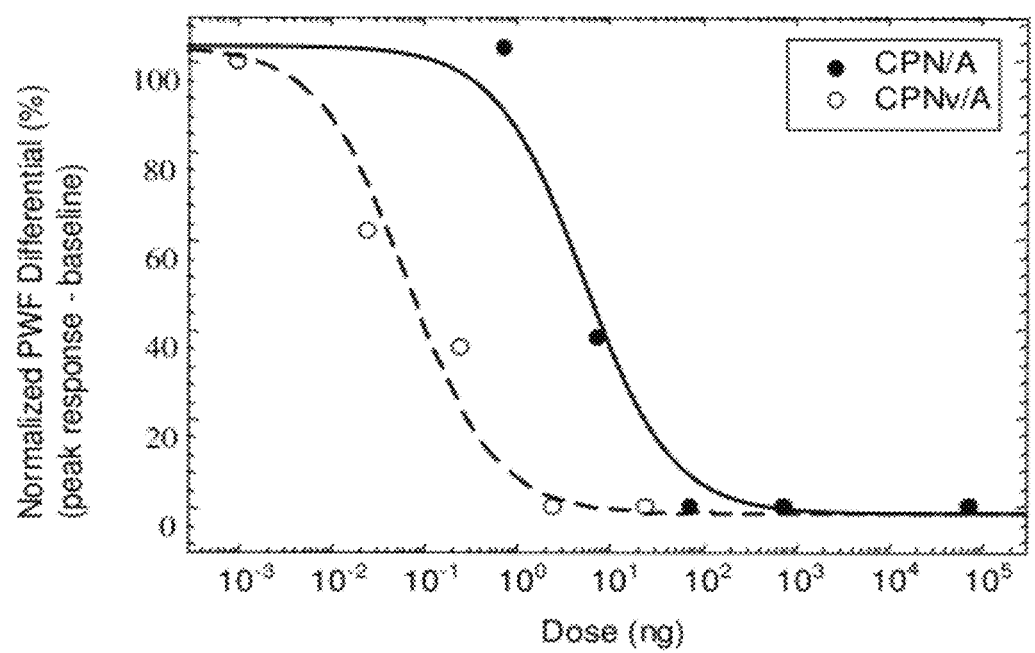

FIG. 21—CPNv-A Efficacy in the Acute Capsaicin-Induced Mechanical Allodynia Model The ability of an LC/A-nociceptin variant-$H_N$/A fusion (CPNv/A) to inhibit capsaicin-induced mechanical allodynia was evaluated following subcutaneous intraplantar injection in the rat hind paw. Test animals were evaluated for paw withdrawal frequency (PWF %) in response to a 10 g Von Frey filament stimulus series (10 stimuli×3 trials) prior to recruitment into the study (Pre-Treat), after subcutaneous intraplantar treatment with CPNv/A but before capsaicin (Pre-CAP), and following capsaicin challenge post-injection of CPNv/A (average of responses at 15' and 30'; CAP). Capsaicin challenge was achieved by injection of 10 µl of a 0.3% solution. Sample dilutions were prepared in 0.5% BSA/saline. These data are expressed as a normalized paw withdrawal frequency differential, in which the difference between the peak response (post-capsaicin) and the baseline response (pre-capsaicin) is expressed as a percentage. With this analysis, it can be seen that CPNv/A is more potent than CPN/A since a lower dose of CPNv/A is required to achieve similar analgesic effect to that seen with CPN/A.

Figure 22:
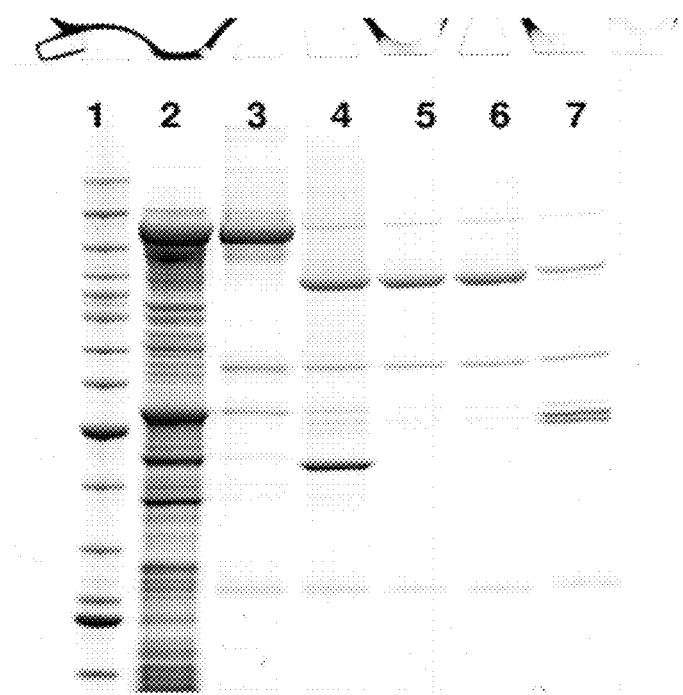

FIG. 22—Expressed/Purified LC/A-CPLE-$H_N$/A Product

Proteins were subjected to SDS-PAGE prior to staining with Coomassie Blue. The electrophoresis profile indicates purification of a disulphide-bonded di-chain species of the expected molecular mass of CPLE-A. Lane 1=benchmark molecular mass markers; Lane 2=total E. coli protein soluble fraction; Lane 3=purified material following initial capture on Ni²⁺-charged Sepharose; Lane 4=Factor Xa treated material prior to final capture on Ni²⁺-charged Sepharose; Lane 5=purified material following second capture on Ni²⁺-charged Sepharose; Lane 6=final purified material; Lane 7=final purified material+DTT.

Figure 23:
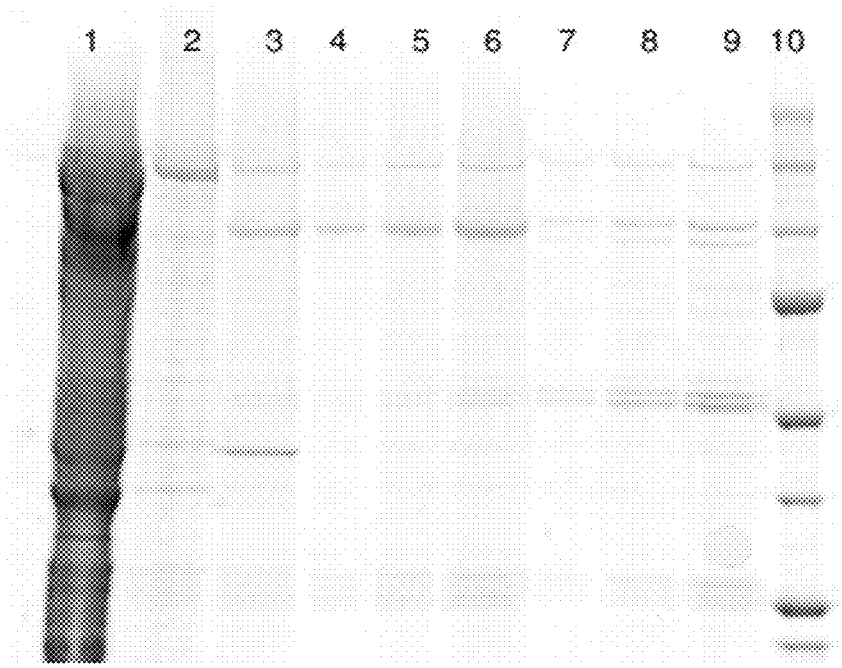

FIG. 23—Expressed/Purified LC/A-CPBE-$H_N$/A Product

Proteins were subjected to SDS-PAGE prior to staining with Coomassie Blue. The electrophoresis profile indicates purification of a disulphide-bonded di-chain species of the expected molecular mass of CPBE-A. Lane 1=total E. coli protein soluble fraction; Lane 2=purified material following initial capture on Ni²⁺-charged Sepharose; Lane 3=Factor Xa treated material prior to final capture on Ni²⁺-charged Sepharose; Lane 4=purified final material post activation with Factor Xa (5 µl); Lane 5=purified final material post activation with Factor Xa (10 µl); Lane 6=purified final material post activation with Factor Xa (20 µl); Lane 7=purified final material post activation with Factor Xa+DTT (5 µl); Lane 8=purified final material post activation with Factor Xa+DTT (10 µl); Lane 9=purified final material post activation with Factor Xa+DTT (20 µl); Lane 10=benchmark molecular mass markers.

Figure 24:
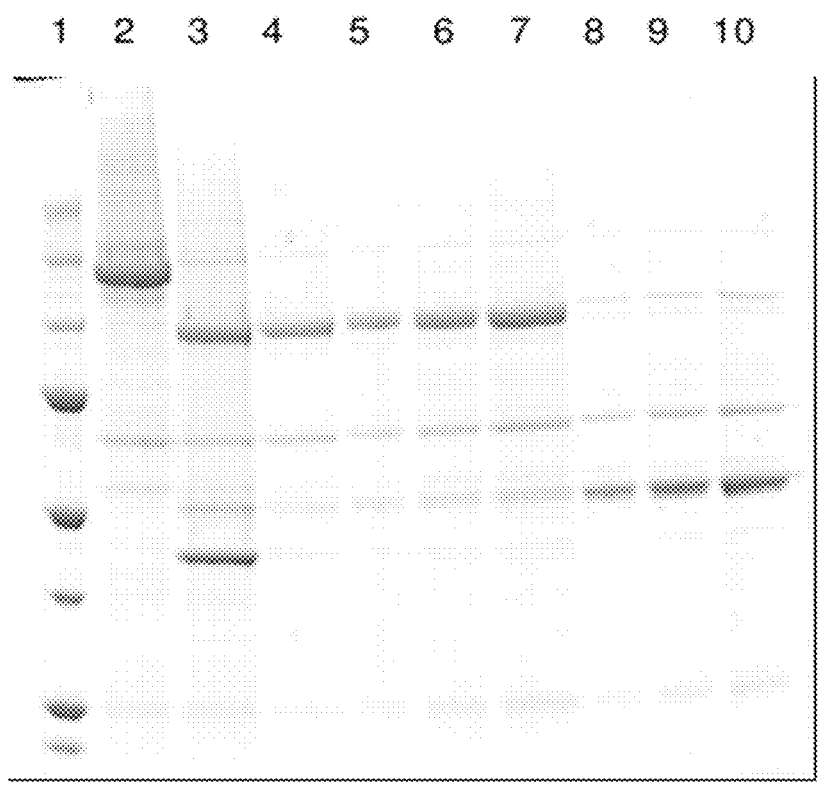

FIG. 24—Expressed/Purified CPOP-A Product

Proteins were subjected to SDS-PAGE prior to staining with Coomassie Blue. The electrophoresis profile indicates purification of a disulphide-bonded di-chain species of the expected molecular mass of CPOP-A. Lane 1=benchmark molecular mass markers; Lane 2=purified material following initial capture on Ni²⁺-charged Sepharose; Lane 3=Factor Xa treated material prior to final capture on Ni²⁺-charged Sepharose; Lane 4=purified material following second capture on Ni²⁺-charged Sepharose; Lane 5=purified final material post activation with Factor Xa (5 µl); Lane 6=purified final material post activation with Factor Xa (10 µl); Lane 7=purified final material post activation with Factor Xa (20 µl); Lane 8=purified final material post activation with Factor Xa+DTT (5 µl); Lane 9=purified final material post activation with Factor Xa+DTT (10 µl); Lane 10=purified final material post activation with Factor Xa+DTT (20 µl).

Figure 25:
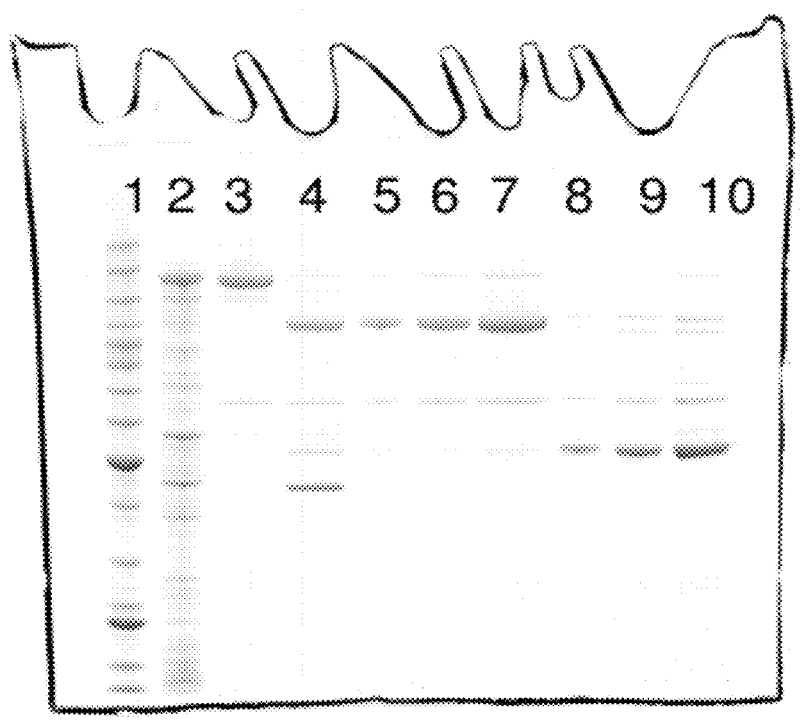

FIG. 25—Expressed/Purified CPOPv-A Product

Proteins were subjected to SDS-PAGE prior to staining with Coomassie Blue. The electrophoresis profile indicates purification of a disulphide-bonded di-chain species of the expected molecular mass of CPOPv-A. Lane 1=benchmark molecular mass markers; Lane 2=total E. coli protein soluble fraction; Lane 3=purified material following initial capture on Ni²⁺-charged Sepharose; Lane 4=Factor Xa treated material prior to final capture on Ni²⁺-charged Sepharose; Lane 5=purified final material post activation with Factor Xa (5 µl); Lane 6=purified final material post activation with Factor Xa (10 µl); Lane 7=purified final material post activation with Factor Xa (20 µl); Lane 8=purified final material post activation with Factor Xa+DTT (5 µl); Lane 9=purified final material post activation with Factor Xa+DTT (10 µl); Lane 10=purified final material post activation with Factor Xa+DTT (20 µl).

Figure 26:
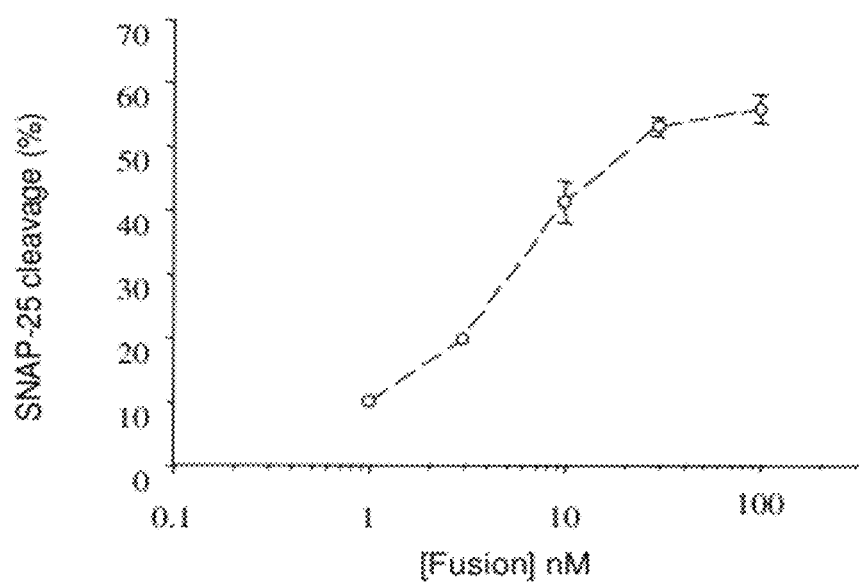

FIG. 26—In Vitro SNAP-25 Cleavage in a DRG CELL Model

Primary cultures of dorsal root ganglia (DRG) were exposed to varying concentrations of CPOPv-A for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis.

Figure 27:
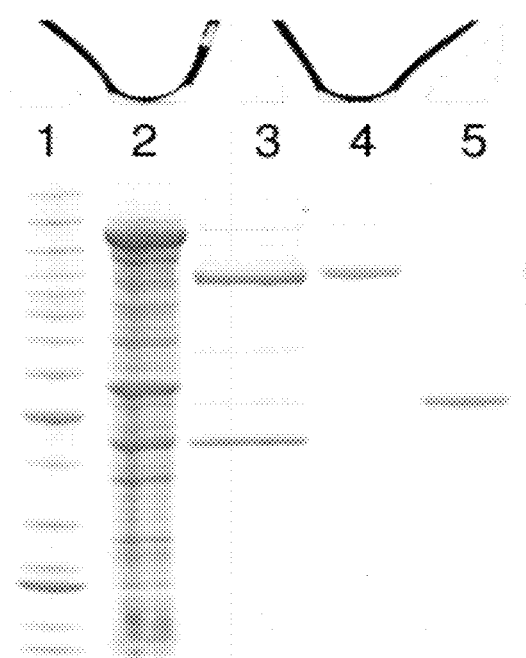

FIG. 27—Expressed/Purified CPNv-A-FXA-HT (Removable HIS-TAG)

Proteins were subjected to SDS-PAGE prior to staining with Coomassie Blue. The electrophoresis profile indicates purification of a disulphide-bonded di-chain species of the expected molecular mass of CPNv-A-FXa-HT. Lane 1=benchmark molecular mass markers; Lane 2=total $E.\ coli$ protein soluble fraction; Lane 3=Factor Xa treated material prior to final capture on $Ni^{2+}$-charged Sepharose; Lane 4=purified final material post activation with Factor Xa; Lane 5=purified final material post activation with Factor Xa+DTT.

Figure 28:
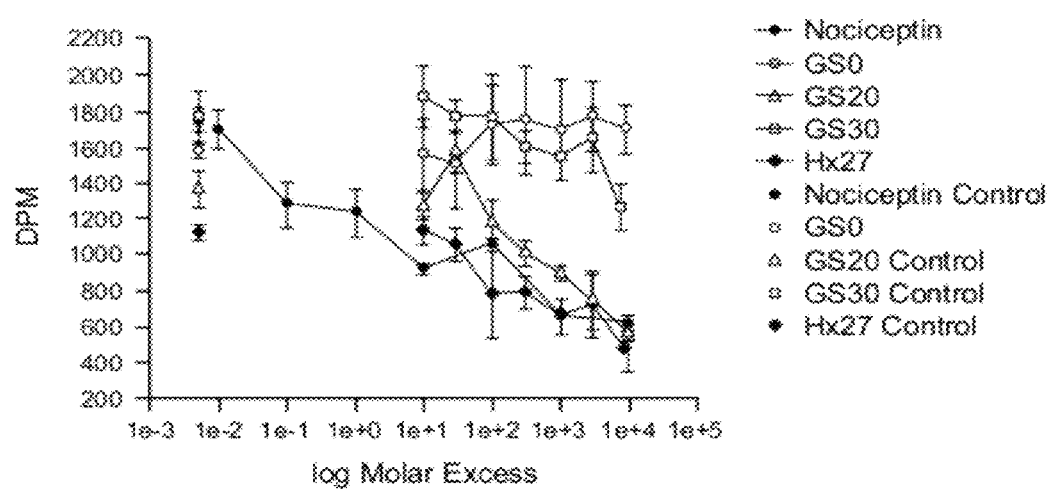
Figure 28:
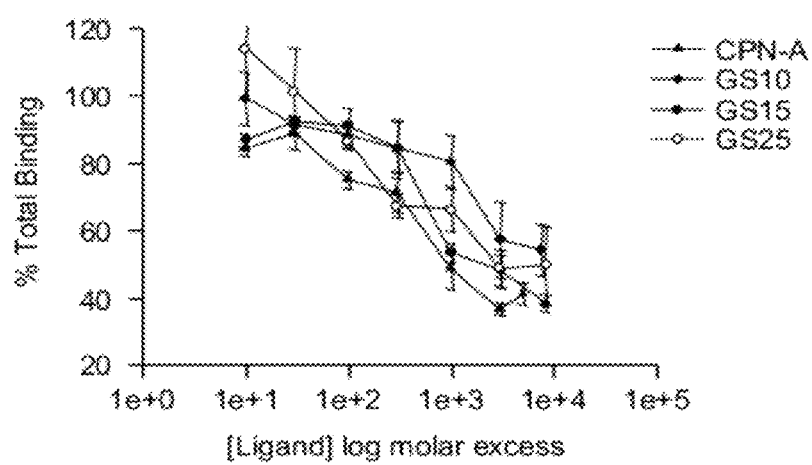

FIG. 28—In Vitro Efficacy of LC/A-Nociceptin-$H_N$/A Fusion Proteins with Variable Spacer Length, as Assessed by Ligand Competition Assay The ability of LC/A-nociceptin-$H_N$/A fusions of variable spacer length to bind to the $ORL_1$ receptor was assessed using a simple competition-based assay. Primary cultures of dorsal root ganglia (DRG) were exposed to varying concentrations of test material in the presence of 1 nM [$^3$H]-nociceptin. The reduction in specific binding of the radiolabelled ligand was assessed by scintillation counting, and plotted in comparison to the efficacy of unlabelled ligand (Tocris nociceptin). The upper panel illustrates the displacement characteristics of the GS0, GS20, GS30 and Hx27 spacers, whilst the lower panel illustrates the displacement achieved by the GS10, GS15 and GS25 spaced fusion proteins. It is concluded that the GS0 and GS30 spacers are ineffective, and the GS10 is poorly effective, at displacing nociceptin from the ORL1 receptor.

Figure 29:
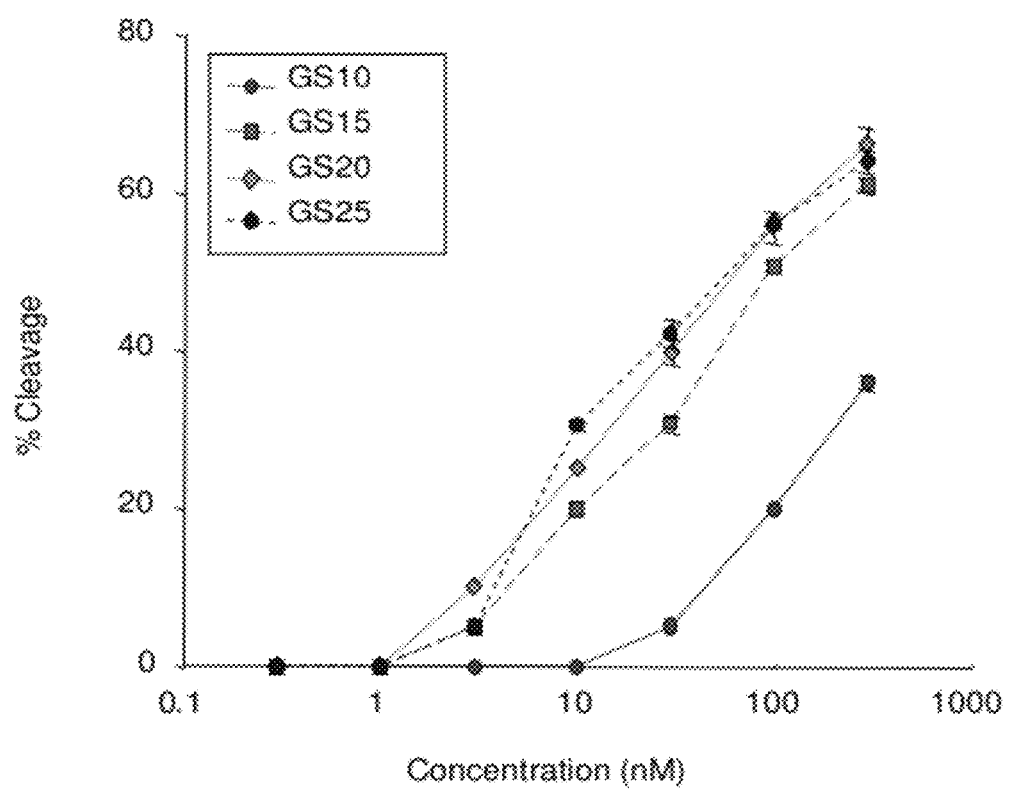

FIG. 29—In Vitro Efficacy of LC/A-Nociceptin-$H_N$/A Fusion Proteins with Variable Spacer Length, as Assessed by In Vitro SNAP-25 Cleavage Primary cultures of dorsal root ganglia (DRG) were exposed to varying concentrations of CPN-A (of variable spacer length) for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. The poorly effective binding characteristics of the GS10 spaced fusion protein (see FIG. 28) are reflected in the higher concentrations of fusion required to achieve cleavage of intracellular SNAP-25. GS0 and GS30 spaced fusion proteins were completely ineffective (date not shown). GS15, 20 and 25 spaced fusion proteins were similarly effective.

Figure 30:
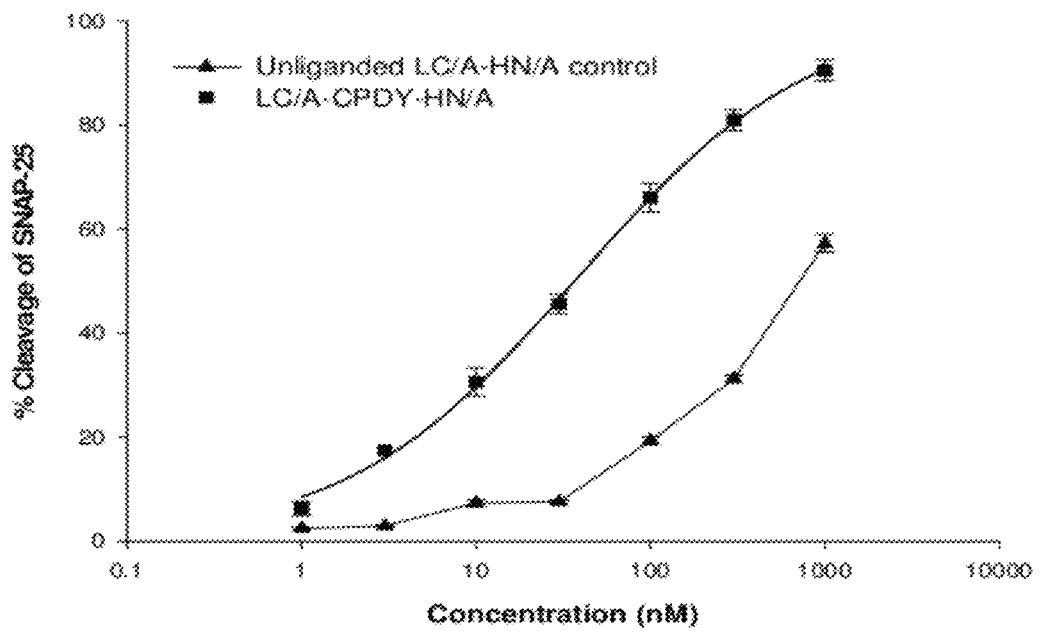

FIG. 30—Cleavage of Snare Protein by Dynorphin Conjugates in Embryonic Spinal Cord Neurons (Escns)

Embryonic spinal cord neurons were exposed to varying concentrations of dynorphin conjugates of the present invention for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. It is clear that LC/A-dynorphin-$H_N$/A fusion is more potent than an unliganded LC/A-$H_N$/A control molecule. The concentration of LC/A-dynorphin-$H_N$/A fusion required to achieve 50% maximal SNAP-25 cleavage is estimated to be 35.3 nM and the concentration for the LC/A-$H_N$/A control required to achieve 50% maximal SNAP-25 cleavage could not be determined due to its low potency.

Figure 31:
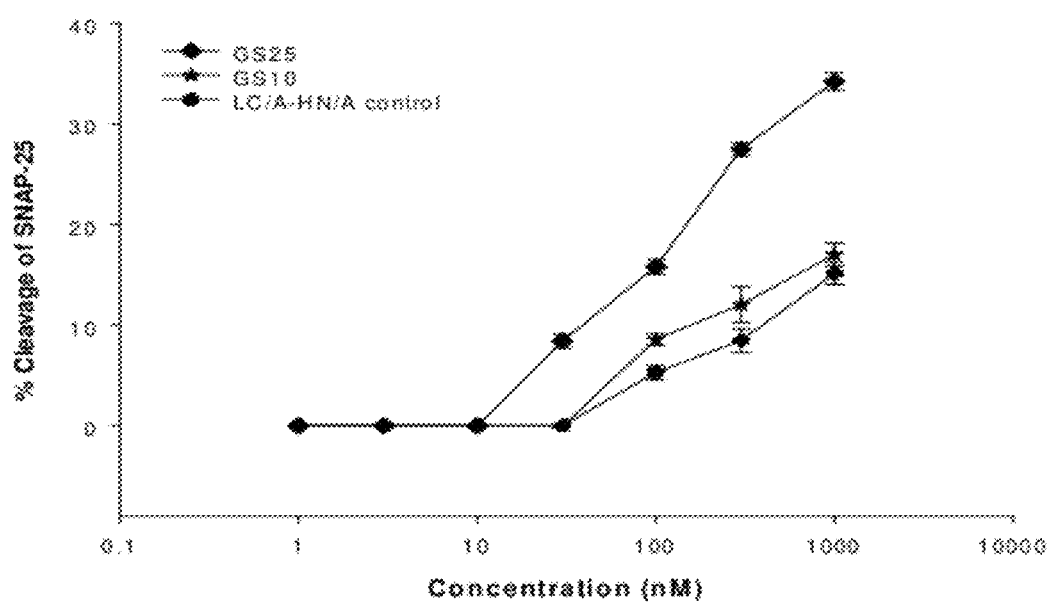

FIG. 31—Cleavage of Snare Protein by Dynorphin Fusion Proteins in Chinese Hamster Ovary Cells (CHO-K1 Cells) Transfected with OP2 Receptor and SNAP-25

Chinese hamster ovary (CHO) cells were transfected so that they express the $OP_2$ receptor. Said cells were further transfected to express a SNARE protein (SNAP-25). The transfected cells were exposed to varying concentrations of different dynorphin conjugates for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. It is clear that the dynorphin fusion proteins are more potent than the unliganded control molecule (labelled as LC/A-$H_N$/A).

Figure 32:
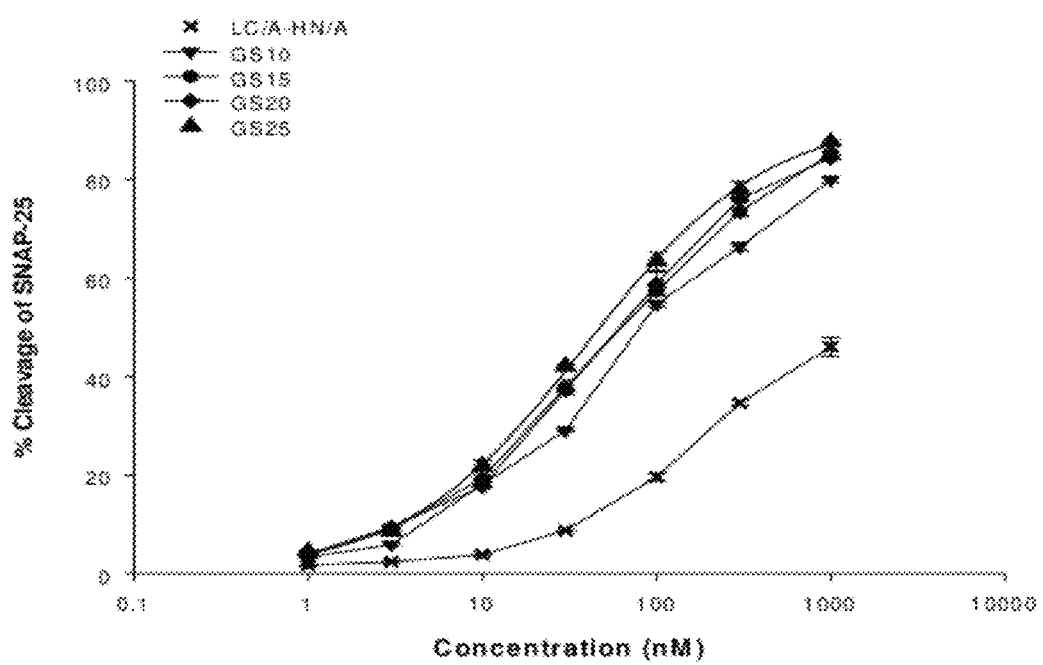

FIG. 32—Cleavage of Snare Protein by Dynorphin Fusion Proteins in Embryonic Spinal Cord Neurons (Escns)

Embryonic spinal cord neurons were exposed to varying concentrations of dynorphin fusion proteins of the present invention for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. It is clear that the dynorphin fusion proteins are more potent than the unliganded control molecule (labelled as LC/A-$H_N$/A).

Figure 33:
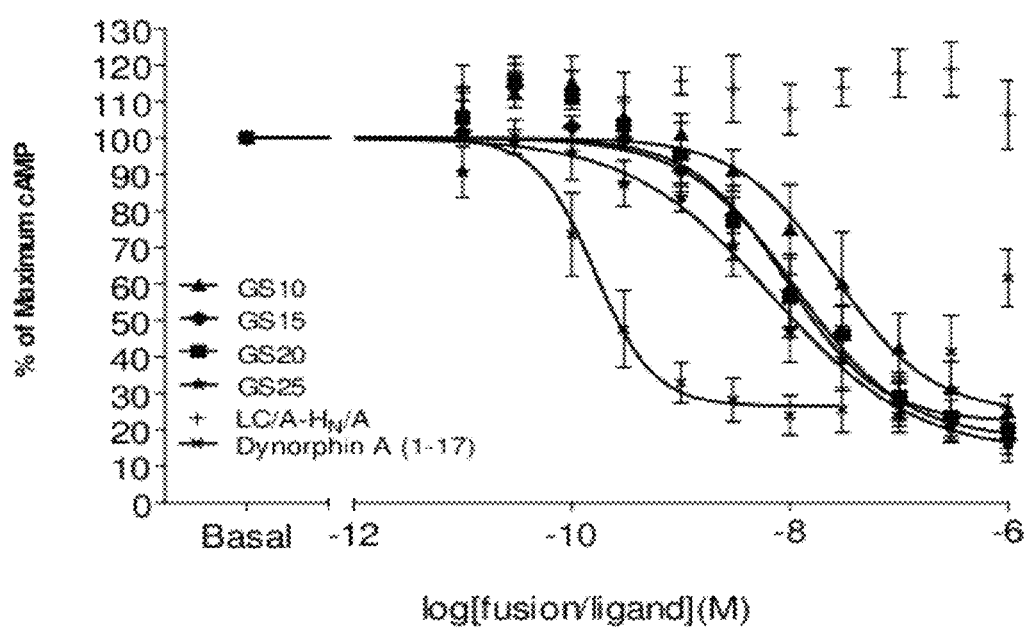

FIG. 33—Kappa Receptor Activation Studies with a Range of Dynorphin Fusion Proteins Chinese hamster ovary (CHO) cells were transfected so that they express the $OP_2$ receptor and SNAP-25. Said cells were used to measure cAMP deletion that occurs when the receptor is activated with a dynorphin ligand, using a FRET-based cAMP kit (LANCE® kit from Perkin Elmer). The transfected cells were exposed to varying concentrations of dynorphin fusion proteins of the present invention for 2 hours. cAMP levels were then detected by addition of a detection mix containing a fluorescently labelled cAMP tracer (Europium-streptavidin/biotin-cAMP) and fluorescently (Alexa) labelled anti-cAMP antibody and incubating at room temperature for 24 hours. Then samples are excited at 320 nM and emitted light measured at 665 nM to determine cAMP levels. It is clear that dynorphin fusion proteins are more potent than the unliganded control molecule (labelled as LC/A-$H_N$/A).

Figure 34:
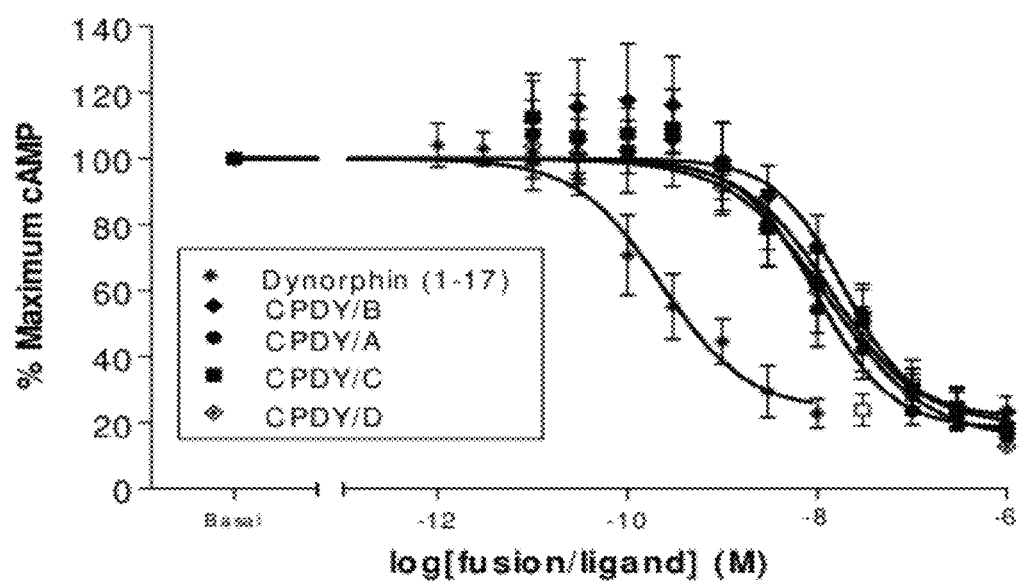

FIG. 34—Kappa Receptor Activation Studies with a Range of Dynorphin Fusion Proteins Chinese hamster ovary (CHO) cells were transfected so that they express the $OP_2$ receptor (purchased from Perkin Elmer). Said cells were transfected so they express SNAP-25 and used to measure cAMP deletion that occurs when the receptor is activated with a dynorphin ligand, using a FRET-based cAMP kit (LANCE® kit from Perkin Elmer). The transfected cells were exposed to varying concentrations of dynorphin fusion proteins of the present invention for 2 hours. cAMP levels were then detected by addition of a detection mix containing a fluorescently labelled cAMP tracer (Europium-streptavadi/biotin-cAMP) and fluorescently (Alexa) labelled anti-cAMP antibody and incubating at room temperature for 24 hours. Then samples are excited at 320 nM and emitted light measured at 665 nM to determine cAMP levels. It is clear from the figure by the reduction in maximum cAMP that the OP2 receptor is activated by LC/A-CPDY-$H_N$/A (labelled as CPDY/A), LC/B-CPDY-$H_N$/B (labelled as CPDY/B), LC/C-CPDY-$H_N$/C (labelled as CPDY/C), and LC/D-CPDY-$H_N$/D (labelled as CPDY/D). The concentration required to achieve 50% reduction in cAMP with LC/A-CPDY-$H_N$/A, LC/B-CPDY-$H_N$/B, LC/C-CPDY-$H_N$/C (labelled as CPDY/, and LC/D-CPDY-$H_N$/D is 10.47 nM, 14.79 nM, 14.79 nM and 23.99 nM, respectively. Dynorphin peptide containing amino acids 1-17 of dynorphin A (labelled as dynorphin (1-17) was more potent than the fusions; 0.15 nM concentration required to achieve 50% reduction of cAMP.

Figure 35:
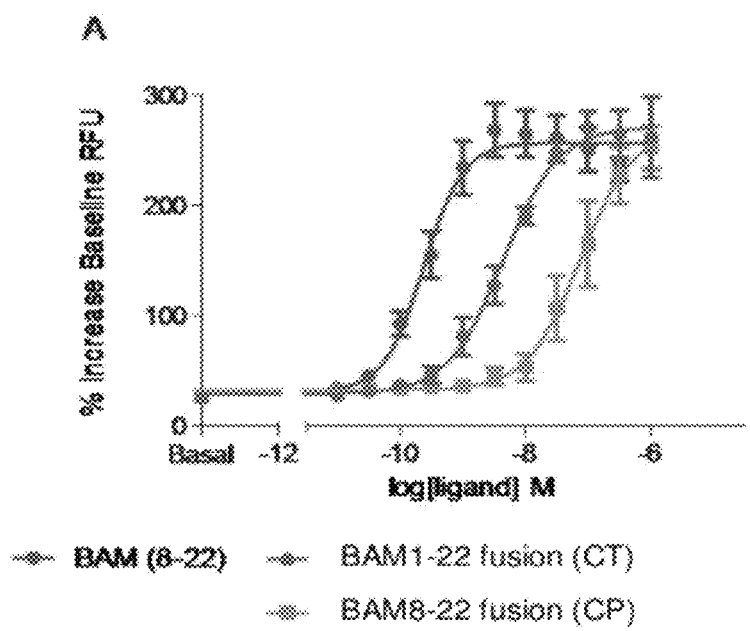

FIG. 35—MrgX1 Receptor Activation Studies with Bam Fusion Proteins

The ability of BAM fusion proteins of the invention to activate the MrgX1 receptor in CHO cells was evaluated by measurement of the potency ($pEC_{50}$) and intrinsic efficacy (Emax) of ligands at the human MrgX1 receptor. Receptor activation by an agonist causes $G\alpha_q$ protein activation resulting in $Ca^{2+}$ release from intracellular stores that is mediated by the target enzyme phospholipase $C\beta$. The transient increase in intracellular $Ca^{2+}$ was measured with a FlexStation3® microplate reader with integrated fluid transfer. CHO cells that express the recombinant human MrgX1 receptor were incubated with the a FLIPR-Calcium-4 masking dye and this $Ca^{2+}$-4 dye formed a complex with $Ca^{2+}$ which fluoresces at 525 nm following excitation at 485 nm allowing signal-detection. An inhibitor of cell membrane anion exchanger, probenecid, was included in the assay buffer to prevent outward transport or sequestration of dye molecules. Following incubation with the dye, the cell plate was loaded onto to the FlexStation3® which transfers BAM fusion proteins (or reference agonist BAMS-22) from a source plate into the microplate wells containing cells. The FlexStation 3® measured the fluorescent-emission from the Calcium-4 dye and readouts were formed as calcium traces displaying the magnitude of calcium flux as a result of MrgX1 receptor activation. The data demonstrated the activation of the MrgX1 receptor by BAM fusion proteins of the invention.

FIG. 36—Bam Fusion Protein Efficacy in Capsaicin-Induced Thermal Hyperalgesia Assay The ability of different BAM fusion proteins of the invention to inhibit capsaicin-induced thermal hyperalgesia was evaluated. Intraplantar pretreatment of fusion proteins into Sprague-Dawley rats and 24 hours later 0.3% capsaicin was injected and rats were put on 25 C glass plate (rats contained in acrylic boxes, on 25° C. glass plate). Light beam (adjustable light Intensity) focused on the hind paw. Sensors detected movement of paw, stopping timer. Paw Withdrawal Latency is the time needed to remove the paw from the heat source (Cut-off of 20.48 seconds). A reduction/inhibition of the paw withdrawal latency indicates that the test substance demonstrates an antinociceptive effect. The data demonstrated the antinociceptive effect of the BAM fusion proteins of the present invention.

FIG. 37—Fusion Protein Efficacy in Capsaicin-Induced Thermal Hyperalgesia Assay

The ability of different fusion proteins of the invention to inhibit capsaicin-induced thermal hyperalgesia was evaluated. Intraplantar pretreatment of fusion proteins into Sprague-Dawley rats and 24 hours later 0.3% capsaicin was injected and rats were put on 25° C. glass plate (rats contained in acrylic boxes, on 25° C. glass plate). Light beam (adjustable light Intensity) focused on the hind paw. Sensors detected movement of paw, stopping timer. Paw Withdrawal Latency is the time needed to remove the paw from the heat source (Cut-off of 20.48 seconds). A reduction/inhibition of the paw withdrawal latency indicates that the test substance demonstrates an antinociceptive effect. The data demonstrated the antinociceptive effect of the fusion proteins of the present invention.

FIG. 38—Mu-Opioid Receptor (OPRM1) Binding Assay with β-Endorphin Fusion Proteins Chinese hamster ovary (CHO) cells were stably transfected with the human mu-opioid receptors (CHO-K1-OPRM1) and used in a radioligand competition binding assay using [$^3$H]-DAMGO. The data demonstrated that the β-endorphin fusion proteins of the present invention having different serotype backbones (i.e., A, B and D) demonstrated a concentration-dependent and almost complete inhibition of the specific binding of [$^3$H]-DAMGO to the human mu-opioid receptors.

Figure 39:
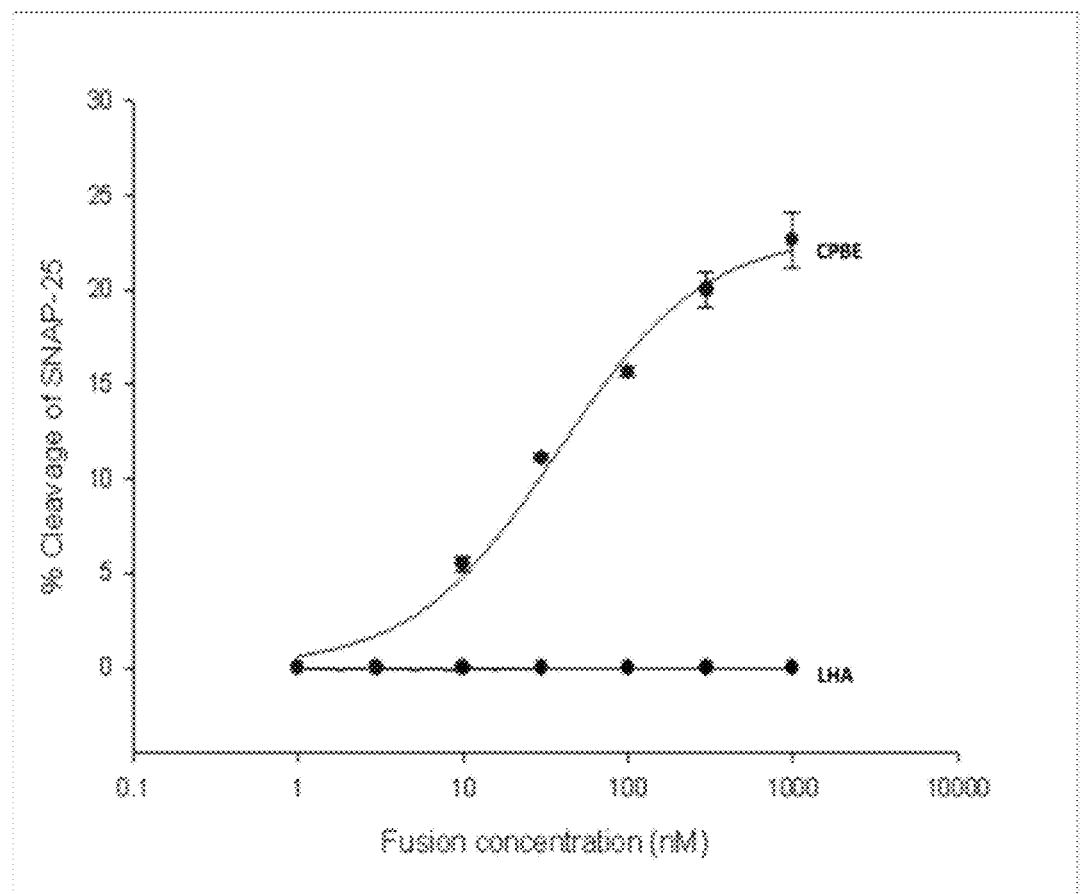

FIG. 39—Cleavage of Snare Protein by B-Endorphin Fusion Proteins in Human Small Cell Lung Carcinoma Cell Line NCI-H69

A SNAP-25 cleavage assay was developed using the human small cell lung carcinoma cell line NCI-H69 expressing endogenous opioid receptors and the activity of β-endorphin fusion proteins was assessed. The data demonstrated efficacy of the β-endorphin fusion protein in SNARE cleavage. Maximum SNAP-25 cleavage achieved by CPBE fusion protein was 23% ($ED_{50}$ 38 nm).

FIG. 40—β-Endorphin Fusion Protein Efficacy in Capsaicin-Induced Paw Guarding Assay The nociceptive flexion reflex (also known as paw guarding assay) is a rapid withdrawal movement that constitutes a protective mechanism against possible limb damage. It can be quantified by assessment of electromyography (EMG) response in anesthetized rat as a result of low dose capsaicin, electrical stimulation or the capsaicin-sensitized electrical response. Intraplantar pretreatment (24 hour) of test substance into 300-380 g male Sprague-Dawley rats. Induction of paw guarding in defined method is achieved by 0.006% capsaicin, 10 μl in PBS (7.5% DMSO), injected in 10 seconds. This produces a robust reflex response from biceps feroris muscle. A reduction/inhibition of the nociceptive flexion reflex indicates that the test substance demonstrates an antinociceptive effect. The paw guarding assay data demonstrated the antinociceptive effect of the β-endorphin fusion proteins of the present invention.

FIG. 41—β-Endorphin Fusion Protein Efficacy in Capsaicin-Induced Thermal Hyperalgesia Assay The ability of different β-endorphin fusion proteins of the invention to inhibit capsaicin-induced thermal hyperalgesia was evaluated. Intraplantar pretreatment of fusion proteins into Sprague-Dawley rats and 24 hours later 0.3% capsaicin was injected and rats were put on 25° C. glass plate (rats contained in acrylic boxes, on 25° C. glass plate). Light beam (adjustable light Intensity) focused on the hind paw. Sensors detected movement of paw, stopping timer. Paw Withdrawal Latency is the time needed to remove the paw from the heat source (Cut-off of 20.48 seconds). A reduction/inhibition of the paw withdrawal latency indicates that the test substance demonstrates an antinociceptive effect. The data demonstrated the antinociceptive effect of the β-endorphin fusion proteins of the present invention.

Figure 42:
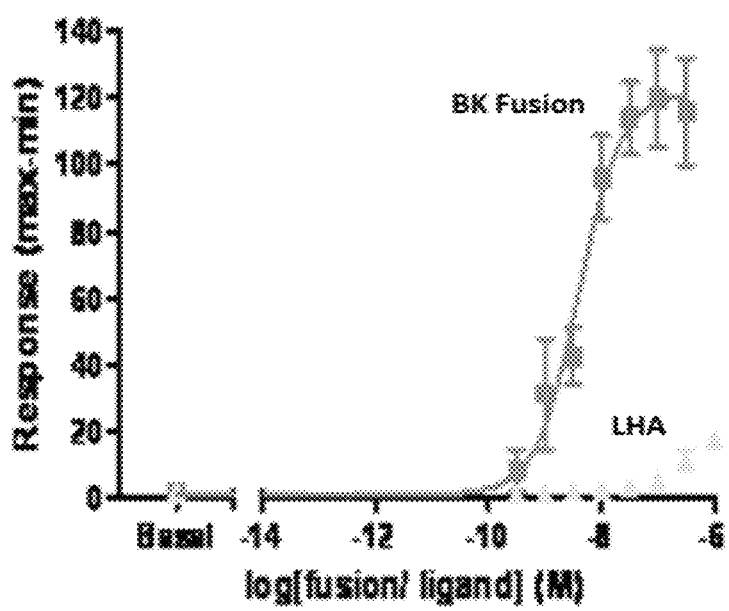

FIG. 42—$B_2$ Receptor Activation Studies with Bradykinin Fusion Proteins

Chinese hamster ovary (CHO) cells were stably transfected with the $B_2$ receptor and used in a calcium fluorimetry assay measuring intracellular calcium levels. The assay allowed the measurement of the potency ($pEC_{50}$) and intrinsic efficacy ($E_{max}$) of the bradykinin fusion protein. The data demonstrated that the bradykinin fusion protein activated the $B_2$ receptor and produced a dose dependent increase in intracellular calcium.

FIG. 43—Bradykinin Fusion Protein Efficacy in Capsaicin-Induced Paw Guarding

The paw guarding assay data (conducted as described above for FIG. 40) demonstrated the antinociceptive effect of the bradykinin fusion proteins of the present invention.

FIG. 44—Bradykinin Fusion Protein Efficacy in Capsaicin-Induced Thermal Hyperalgesia Assay The thermal hyperalgesia assay data demonstrated (conducted as described above for FIG. 41) the antinociceptive effect of the bradykinin fusion proteins of the present invention.

Figure 45:
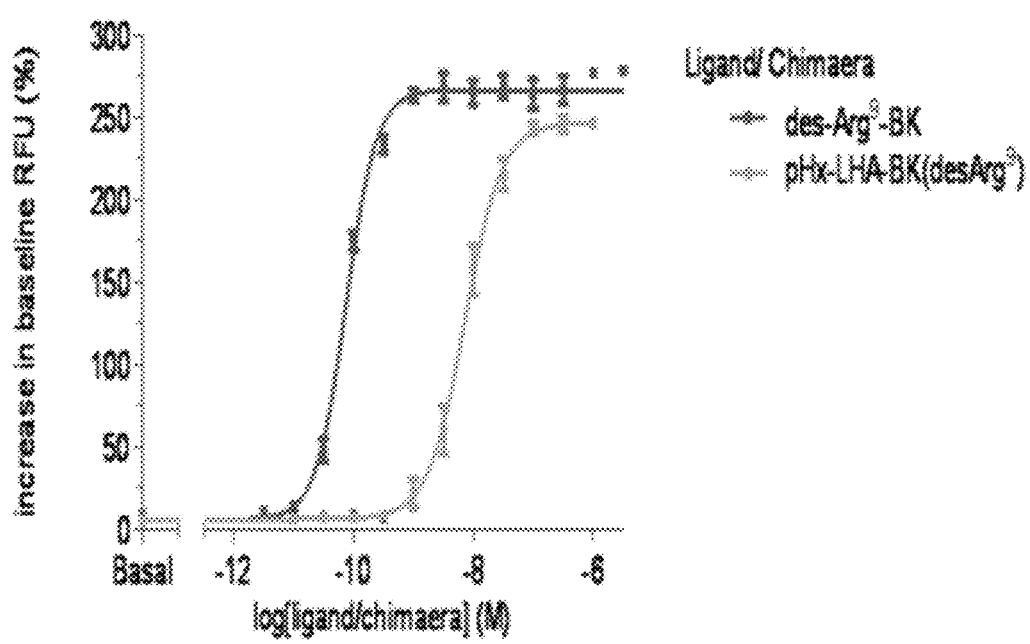

FIG. 45—$B_2$ Receptor Activation Studies with DES-ARG$^9$-Bradykinin Fusion Proteins Chinese hamster ovary (CHO) cells were stably transfected with the $B_1$ receptor and used in a calcium fluorimetry assay measuring intracellular calcium levels. The assay allowed the measurement of the potency ($pEC_{50}$) and intrinsic efficacy ($E_{max}$) of fusion proteins having the des-Arg$^9$-BK ligand. The data demonstrated that the des-Arg$^9$-BK fusion protein activated the $B_1$ receptor and produced a dose dependent increase in intracellular calcium.

DETAILED DESCRIPTION

The use of an "agonist", which would normally stimulate a biological process, particularly exocytosis (for example, an increase in cellular secretion, or an up-regulation in membrane protein expression), is an exciting development in the technical field of re-targeted toxins. Furthermore, it is particularly surprising that an agonist may be employed in a therapeutic composition to achieve a reduction or inhibition of a biological process that the agonist would normally stimulate.

The fusion proteins of the present invention represent a distinct sub-set of toxin conjugates. In more detail, the fusion proteins of the present invention comprise TMs that have been selected on the basis of specific properties rather than on the simple basis that they have a corresponding receptor on a pain-sensing target cell of interest.

The non-cytotoxic protease component of the present invention is a non-cytotoxic protease, or a fragment thereof, which protease or protease fragment is capable of cleaving different but specific peptide bonds in one of three substrate proteins, namely synaptobrevin, syntaxin or SNAP-25, of the exocytic fusion apparatus in a nociceptive sensory afferent. These substrates are important components of the neurosecretory machinery. The non-cytotoxic protease component of the present invention is preferably a neisserial IgA protease or a fragment thereof or a clostridial neurotoxin L-chain or a fragment thereof. A particularly preferred non-cytotoxic protease component is a botulinum neurotoxin (BoNT) L-chain or a fragment thereof.

The translocation component of the present invention enables translocation of the non-cytotoxic protease (or fragment thereof) into the target cell such that functional expression of protease activity occurs within the cytosol of the target cell. The translocation component is preferably capable of forming ion-permeable pores in lipid membranes under conditions of low pH. Preferably it has been found to use only those portions of the protein molecule capable of pore-formation within the endosomal membrane. The translocation component may be obtained from a microbial protein source, in particular from a bacterial or viral protein source. Hence, in one embodiment, the translocation component is a translocating domain of an enzyme, such as a bacterial toxin or viral protein. The translocation component of the present invention is preferably a clostridial neurotoxin H-chain or a fragment thereof. Most preferably it is the $H_N$ domain (or a functional component thereof), wherein $H_N$ means a portion or fragment of the H-chain of a clostridial neurotoxin approximately equivalent to the amino-terminal half of the H-chain, or the domain corresponding to that fragment in the intact H-chain.

The TM component of the present invention is responsible for binding the fusion protein of the present invention to a Binding Site on a target cell. Thus, the TM component is simply a ligand through which a fusion protein of the present invention binds to a selected target cell.

In the context of the present invention, the target cell is a nociceptive sensory afferent, preferably a primary nociceptive afferent (e.g., an A-fibre such as an Aδ-fibre or a C-fibre). Thus, the fusion proteins of the present invention are capable of inhibiting neurotransmitter or neuromodulator (e.g., glutamate, substance P, calcitonin-gene related peptide (CGRP), and/or neuropeptide Y) release from discrete populations of nociceptive sensory afferent neurons. In use, the fusion proteins reduce or prevent the transmission of sensory afferent signals (e.g., neurotransmitters or neuromodulators) from peripheral to central pain fibres, and therefore have application as therapeutic molecules for the treatment of pain, in particular chronic pain.

It is routine to confirm that a TM binds to a nociceptive sensory afferent. For example, a simple radioactive displacement experiment may be employed in which tissue or cells representative of the nociceptive sensory afferent (for example DRGs) are exposed to labelled (e.g., tritiated) ligand in the presence of an excess of unlabelled ligand. In such an experiment, the relative proportions of non-specific and specific binding may be assessed, thereby allowing confirmation that the ligand binds to the nociceptive sensory afferent target cell. Optionally, the assay may include one or more binding antagonists, and the assay may further comprise observing a loss of ligand binding. Examples of this type of experiment can be found in Hulme, E. C. (1990), Receptor-binding studies, a brief outline, pp. 303-311, in *Receptor Biochemistry, A Practical Approach*, Ed. E. C. Hulme, Oxford University Press.

The fusion proteins of the present invention generally demonstrate a reduced binding affinity (in the region of up to 100-fold) for nociceptive sensory afferent target cells when compared with the corresponding 'free' TM. However, despite this observation, the fusion proteins of the present invention surprisingly demonstrate good efficacy. This can be attributed to two principal features. First, the non-cytotoxic protease component is catalytic—thus, the therapeutic effect of a few such molecules is rapidly amplified. Secondly, the receptors present on the nociceptive sensory afferents need only act as a gateway for entry of the therapeutic, and need not necessarily be stimulated to a level required in order to achieve a ligand-receptor mediated pharmacological response. Accordingly, the fusion proteins of the present invention may be administered at a dosage that is much lower that would be employed for other types of analgesic molecules such as NSAIDS, morphine, and gabapentin. The latter molecules are typically administered at high microgram to milligram (even up to hundreds of milligram) quantities, whereas the fusion proteins of the present invention may be administered at much lower dosages, typically at least 10-fold lower, and more typically at 100-fold lower.

The TM preferably comprises a maximum of 50 amino acid residues, more preferably a maximum of 40 amino acid residues, particularly preferably a maximum of 30 amino acid residues, and most preferably a maximum of 20 amino acid residues.

Opioids represent a preferred group of TMs of the present invention. Within this family of peptides is included enkephalins (met and leu), endomorphins 1 and 2, β-endorphin and dynorphin. Opioid peptides are frequently used in the clinic to modify the activity to nociceptors, and other cells involved in the pain response. As exemplified by the three-step World Health Organisation Analgesic Ladder, opioids have entry points into the pharmacological treatment of chronic cancer and non-cancer pain at all three stages, underlining their importance to the treatment of pain. Reference to opioids embraces fragments, variants and derivatives thereof, which retain the ability to bind to nociceptive sensory afferents.

The TM of the invention can also be a molecule that acts as an "agonist" at one or more of the receptors present on a nociceptive sensory afferent, more particularly on a primary nociceptive afferent. Conventionally, an agonist has been considered any molecule that can either increase or decrease activities within a cell, namely any molecule that simply causes an alteration of cell activity. For example, the conventional meaning of an agonist would include a chemical substance capable of combining with a receptor on a cell and initiating a reaction or activity, or a drug that induces an active response by activating receptors, whether the response is an increase or decrease in cellular activity.

However, for the purposes of this invention, an agonist is more specifically defined as a molecule that is capable of stimulating the process of exocytic fusion in a target cell, which process is susceptible to inhibition by a protease (or fragment thereof) capable of cleaving a protein of the exocytic fusion apparatus in said target cell.

Accordingly, the particular agonist definition of the present invention would exclude many molecules that would be conventionally considered as agonists. For example, nerve growth factor (NGF) is an agonist in respect of its ability to promote neuronal differentiation via binding to a TrkA receptor. However, NGF is not an agonist when assessed by the above criteria because it is not a principal inducer of exocytic fusion. In addition, the process that NGF stimulates (i.e., cell differentiation) is not susceptible to inhibition by the protease activity of a non-cytotoxic toxin molecule.

In one embodiment, the fusion proteins according to the present invention demonstrate preferential receptor binding and/or internalisation properties. This, in turn, may result in more efficient delivery of the protease component to a pain-sensing target cell.

Use of an agonist as a TM is self-limiting with respect to side-effects. In more detail, binding of an agonist TM to a pain-sensing target cell increases exocytic fusion, which may exacerbate the sensation of pain. However, the exocytic process that is stimulated by agonist binding is subsequently reduced or inhibited by the protease component of the fusion protein.

The agonist properties of a TM that binds to a receptor on a nociceptive afferent can be confirmed using the methods described in Example 10.

In one embodiment of the invention, the target for the TM is the $ORL_1$ receptor. This receptor is a member of the G-protein-coupled class of receptors, and has a seven transmembrane domain structure. The properties of the $ORL_1$ receptor are discussed in detail in Mogil & Pasternak (2001), *Pharmacological Reviews,* 53(3):381-415.

In one embodiment, the TM is a molecule that binds (preferably that specifically binds) to the $ORL_1$ receptor. More preferably, the TM is an "agonist" of the $ORL_1$ receptor. The term "agonist" in this context is defined as above.

The agonist properties of a TM that binds to an $ORL_1$ receptor can be confirmed using the methods described in Example 10. These methods are based on previous experiments (see Inoue et al. 1998 (*Proc. Natl. Acad. Sci.,* 95:10949-10953)), which confirm that the natural agonist of the $ORL_1$ receptor, nociceptin, causes the induction of substance P release from nociceptive primary afferent neurons. This is supported by the fact that:

- the nociceptin-induced responses are abolished by specific NK1 receptor (the substance P receptor) antagonists; and
- pre-treatment of the cells with capsaicin (which depletes substance P from small diameter primary afferent neurons) attenuates the nociceptin-induced responses.

Similarly, Inoue et al. confirm that an intraplantar injection of botulinum neurotoxin type A abolishes the nociceptin-induced responses. Since it is known that BoNT inhibits the release of substance P from primary afferent neurons (Welch et al., 2000, *Toxicon,* 38:245-258), this confirms the link between nociceptin-$ORL_1$ interaction and subsequent release of substance P.

Thus, a TM can be said to have agonist activity at the $ORL_1$ receptor if the TM causes an induction in the release of substance P from a nociceptive sensory afferent neuron (see Example 10).

In a particularly preferred embodiment of the invention, the TM is nociceptin—the natural ligand for the $ORL_1$ receptor. Nociceptin targets the $ORL_1$ receptor with high affinity. Examples of other preferred TMs include:

| Code | Sequence | Ref. | SEQ ID NO:. |
|---|---|---|---|
| Nociceptin 1-17 | FGGFTGARKSARKLANQ | 1 | 37, 38 |
| Nociceptin 1-11 | FGGFTGARKSA | 1 | 39, 40 |
| Nociceptin [Y10] 1-11 | FGGFTGARKYA | 1 | 41, 42 |
| Nociceptin [Y11] 1-11 | FGGFTGARKSY | 1 | 43, 44 |
| Nociceptin [Y14] 1-17 | FGGFTGARKSARKYANQ | 1 | 45, 46 |
| Nociceptin 1-13 | FGGFTGARKSARK | 2 | 47, 48 |
| Nociceptin [R14K15] 1-17 (also known in this specification as "variant" nociceptin) | FGGFTGARKSARKRKNQ | 3, 4 | 49, 50 |
| Peptide agonist | Peptide agonists from combinatorial library approach | 5 | — |

1 Mogil & Pasternak, 2001, Pharmacol. Rev., 53:381-415

2 Maile et al., 2003, Neurosci. Lett., 350:190-192

3 Rizzi et al., 2002, J. Pharmacol. Exp. Therap., 300:57-63

4 Okada et al., 2000, Biochem. Biophys. Res. Commun., 278:493-498

5 Dooley et al., 1997, J. Pharmacol. Exp. Ther. 283(2):735-41.

The above-identified "variant" TM demonstrates particularly good binding affinity (when compared with natural nociceptin) for nociceptive sensory afferents. This is surprising as the amino acid modifications occur at a position away from the N-terminus of the TM. Moreover, the modifications are almost at the C-terminus of the TM, which in turn is attached to a large polypeptide sequence (i.e., the translocation domain). Generally speaking, a TM-containing fusion protein will demonstrate an approximate 100-fold reduction in binding ability vis-à-vis the TM per se. The above-mentioned "variant" TM per se demonstrates an approximate 3- to 10-fold increase in binding ability for a nociceptive sensory afferent (e.g., via the $ORL_1$ receptor) vis-à-vis natural nociceptin. Thus, a "variant" TM-containing fusion might be expected to demonstrate an approximate 10-fold reduction in binding ability for a nociceptive sensory afferent (e.g., via the $ORL_1$ receptor) vis-à-vis 'free' nociceptin. However, the present inventors have demonstrated that such "variant" TM-containing fusion proteins demonstrate a binding ability that (most surprisingly) closely mirrors that of 'free' nociceptin—see FIG. 14.

In the context of the present invention, the term opioid or an agonist of the $ORL_1$ receptor (such as nociceptin, or any one of the peptides listed in the table above) embraces molecules having at least 70%, preferably at least 80%, more preferably at least 90%, and most preferably at least 95% amino acid sequence acid identity/homology with said opioid or agonist. The agonist homologues retain the agonist properties of nociceptin at the $ORL_1$ receptor, which may be tested using the methods provided in Example 10. Similarly, an opioid homologue substantially retains the binding function of the opioid with which it shows high amino acid sequence identity/homology.

The invention also encompasses fragments, variants, and derivatives of any one of the TMs described herein. These fragments, variants, and derivatives substantially retain the properties that are ascribed to said TMs.

In addition to the above-mentioned opioid and non-opioid classes of TMs, a variety of other polypeptides are suitable for targeting the fusion proteins of the present invention to nociceptive sensory afferents (e.g., to nociceptors). In this regard, particular reference is made to galanin and derivatives of galanin. Galanin receptors are found pre- and post-synaptically in DRGs (Liu & Hokfelt, (2002), *Trends Pharm. Sci.*, 23(10):468-74), and are enhanced in expression during neuropathic pain states. Proteinase-activated receptors (PARs) are also a preferred group of TMs of the present invention, most particularly PAR-2. It is known that agonists of PAR-2 induce/elicit acute inflammation, in part via a neurogenic mechanism. PAR2 is expressed by primary spinal afferent neurons, and PAR2 agonists stimulate release of substance P(SP) and calcitonin gene-related peptide (CGRP) in peripheral tissues. Another preferred group of TMs of the present invention include bovine adrenal medullary (BAM) peptides, bradykinin and/or substance P.

Another particularly preferred set of TMs of the present invention includes:

| Ligand | Reference |
| --- | --- |
| Nociceptin | Guerrini, et al., (1997) *J. Med. Chem.*, 40: 1789-1793 |
| β-endorphin | Blanc, et al., (1983) *J. Biol. Chem.*, 258(13): 8277-8284 |
| Endomorphin-1; Endomorphin-2 | Zadina, et al., (1997). *Nature*, 386: 499-502 |
| Dynorphin | Fields & Basbaum (2002) Chapter 11, In *The Textbook of Pain*, Wall & Melzack eds. |
| Met-enkephalin | Fields & Basbaum (2002) Chapter 11, In *The Textbook of Pain*, Wall & Melzack eds. |
| Leu-enkephalin | Fields & Basbaum (2002) Chapter 11, In *The Textbook of Pain*, Wall & Melzack eds. |
| Galanin | Xu et al., (2000) *Neuropeptides*, 34(3&4): 137-147 |
| PAR-2 peptide | Vergnolle et al., (2001) *Nat. Med.*, 7(7): 821-826 |

In a preferred embodiment of the invention, the target for the TM is selected from the group consisting of: Mrg receptors such as MrgX1, opioid receptors such as OPRD1 and/or OPRM1, BDKRB1 and/or BDKRB2, Tachykinin receptors such as TACR1, TACR2 and/or TACR3, Kappa receptor (OPRK1) and/or $ORL_1$ receptor.

In one embodiment, the TM is a molecule that binds (preferably that specifically binds) to one or more of the above-mentioned receptors. For example, the TM is an "agonist" of one or more of the above-mentioned receptors. The term "agonist" in this context is defined as above.

In one embodiment, the TM comprises or consists of a BAM peptide. Full-length BAM is a 22 amino acid peptide, abbreviated herein as BAM1-22 (represented by SEQ ID NO:108). In one embodiment, the BAM TM of the invention comprises or consists of a 15 amino acid fragment of full-length BAM peptide and is referred to herein as BAM8-22 (represented by SEQ ID NO:109). In one embodiment, said BAM peptides bind (preferably specifically bind) to Mrg receptors such as MrgX1.

In one embodiment, the TM comprises or consists of a β-endorphin peptide. β-endorphin is a 31 amino acid peptide (represented by SEQ ID NO:114). In one embodiment, said β-endorphin peptide binds (preferably specifically binds) opioid receptors such as OPRD1 and/or OPRM1.

In one embodiment, the TM comprises or consists of a bradykinin peptide. bradykinin is a 9 amino acid peptide (represented by SEQ ID NO:117). In one embodiment, said bradykinin peptide binds (preferably specifically binds) bradykinin target receptors BDKRB1 and/or BDKRB2.

In one embodiment, the TM comprises or consists of a des-$Arg^9$-BK ligand (represented by SEQ ID NO:118). The des-$Arg^9$-Bradykinin ligand differs from bradykinin ligand by the removal of an arginine residue from the C-terminus. In one embodiment, said des-$Arg^9$-BK ligand binds (preferably specifically binds) bradykinin target receptors BDKRB1 and/or BDKRB2.

In one embodiment, the TM comprises or consists of a substance P peptide. Full length substance P is an 11 amino acid peptide (represented by SEQ ID NO:122). In one embodiment, the TM comprises or consists of a substance P analogue, such as the analogue referred to herein as 'S6' (represented by SEQ ID NO:123). In one embodiment, said substance P peptide, or analogue thereof binds (preferably specifically binds) to Tachykinin receptors such as TACR1, TACR2 and/or TACR3.

In one embodiment, the TM comprises or consists of a dynorphin peptide. The sequence of dynorphin is represented by SEQ ID NO:89. In one embodiment, said dynorphin peptide binds (preferably specifically binds) Kappa receptor (OPRK1).

The invention also encompasses fragments, variants, and derivatives and analogues of the above-mentioned TMs. These fragments, variants, and derivatives and analogues substantially retain the properties that are ascribed to said TM. For example, the fragments, variants, and derivatives may retain the ability to bind to one their respective receptor(s). By way of example, reference is made to the above-mentioned BAM8-22 fragment of the full length BAM1-22 TM as well as the substance P analogue S6.

In one embodiment, the TM comprises or consists of an amino acid sequence having at least 70%, preferably at least 80% (such as at least 82, 84, 85, 86, 88 or 89%), more preferably at least 90% (such as at least 91, 92, 93 or 94%), and most preferably at least 95% (such as at least 96, 97, 98, 99 or 100%) amino acid sequence acid identity to SEQ ID NOs:38, 40, 42, 44, 46, 48, 50, 89, 108, 109, 114, 117, 118, 122, and/or 123.

In one embodiment, the TM comprises or consists of an amino acid sequence having at least 70%, preferably at least 80% (such as at least 82, 84, 85, 86, 88 or 89%), more preferably at least 90% (such as at least 91, 92, 93 or 94%), and most preferably at least 95% (such as at least 96, 97, 98, 99 or 100%) amino acid sequence acid identity to SEQ ID NOs:108, 109, 114, 117, 118, 122 and/or 123.

In one embodiment, the Targeting Moiety comprises or consists of an amino acid sequence according to SEQ ID NO:38, 89, 108, 114, 117, 118, 122 and/or 123 or a fragment comprising or consisting of at least 16 (such as at least 5, 6, 7, 8, 9, 10, 11, 12, 13, 14 or 15) contiguous amino acid residues thereof, or a variant amino acid sequence of said SEQ ID NO:38, 89, 108, 114, 117, 118, 122 and/or 123 or said fragment having a maximum of 6 (such as a maximum of 5, 4, 3, 2 or 1) conservative amino acid substitutions.

The protease cleavage site of the present invention allows cleavage (preferably controlled cleavage) of the fusion protein at a position between the non-cytotoxic protease component and the TM component. It is this cleavage reaction that converts the fusion protein from a single chain polypeptide into a disulphide-linked, di-chain polypeptide.

According to a preferred embodiment of the present invention, the TM binds via a domain or amino acid sequence that is located away from the C-terminus of the TM. For example, the relevant binding domain may include an intra domain or an amino acid sequence located towards the middle (i.e., of the linear peptide sequence) of the TM. Preferably, the relevant binding domain is located towards the N-terminus of the TM, more preferably at or near to the N-terminus.

In one embodiment, the single chain polypeptide fusion may include more than one proteolytic cleavage site. However, where two or more such sites exist, they are different, thereby substantially preventing the occurrence of multiple cleavage events in the presence of a single protease. In another embodiment, it is preferred that the single chain polypeptide fusion has a single protease cleavage site.

The protease cleavage sequence(s) may be introduced (and/or any inherent cleavage sequence removed) at the DNA level by conventional means, such as by site-directed mutagenesis. Screening to confirm the presence of cleavage sequences may be performed manually or with the assistance of computer software (e.g., the MapDraw program by DNASTAR, Inc.).

Whilst any protease site may be employed, the following are preferred:

| | | |
|---|---|---|
| Enterokinase | (DDDDK↓) | SEQ ID NO: 158 |
| Factor Xa | (IEGR↓/IDGR↓) | SEQ ID NO: 159 |
| TEV(Tobacco Etch virus) | (ENLYFQ↓G) | SEQ ID NO: 160 |
| Thrombin | (LVPR↓GS) | SEQ ID NO: 161 |
| PreScission | (LEVLFQ↓GP) | SEQ ID NO: 162 |

Also embraced by the term protease cleavage site is an intein, which is a self-cleaving sequence. The self-splicing reaction is controllable, for example by varying the concentration of reducing agent present.

In use, the protease cleavage site is cleaved and the N-terminal region (preferably the N-terminus) of the TM becomes exposed. The resulting polypeptide has a TM with an N-terminal domain or an intra domain that is substantially free from the remainder of the fusion protein. This arrangement ensures that the N-terminal component (or intra domain) of the TM may interact directly with a Binding Site on a target cell.

In a preferred embodiment, the TM and the protease cleavage site are distanced apart in the fusion protein by at most 10 amino acid residues, more preferably by at most 5 amino acid residues, and most preferably by zero amino acid residues. Thus, following cleavage of the protease cleavage site, a fusion is provided with a TM that has an N-terminal domain that is substantially free from the remainder of the fusion. This arrangement ensures that the N-terminal component of the Targeting Moiety may interact directly with a Binding Site on a target cell.

One advantage associated with the above-mentioned activation step is that the TM only becomes susceptible to N-terminal degradation once proteolytic cleavage of the fusion protein has occurred. In addition, the selection of a specific protease cleavage site permits selective activation of the polypeptide fusion into a di-chain conformation.

Construction of the single-chain polypeptide fusion of the present invention places the protease cleavage site between the TM and the non-cytotoxic protease component.

It is preferred that, in the single-chain fusion, the TM is located between the protease cleavage site and the translocation component. This ensures that the TM is attached to the translocation domain (i.e., as occurs with native clostridial holotoxin), though in the case of the present invention the order of the two components is reversed vis-à-vis native holotoxin. A further advantage with this arrangement is that the TM is located in an exposed loop region of the fusion protein, which has minimal structural effects on the conformation of the fusion protein. In this regard, said loop is variously referred to as the linker, the activation loop, the inter-domain linker, or just the surface exposed loop (Schiavo et al., 2000, *Phys. Rev.,* 80:717-766; Turton et al., 2002, *Trends Biochem. Sci.,* 27:552-558).

In another embodiment of the present invention, the TM is either N- or C-terminally located with respect to the fusion protein. In other words, in one embodiment the TM is not located between the non-cytotoxic protease and translocation domain components of the single-chain polypeptide fusion protein.

In one embodiment, the invention provides a single-chain polypeptide fusion protein comprising (or consisting of) an amino acid sequence having at least 80% (such as at least 85, 90, 92, 94, 95, 96, 97, 98, 99 or 100%) sequence identity to the amino acid sequence of SEQ ID NOs:24, 98, 99, 100, 101, 102, 103, 104, 105, 106, 107, 111, 112, 113, 115, 116, 120, 121, 124, 125, 126, 129, 130, 131, 132, 133, 134, 135, 136, 137, 138, 139, 140, 141, 142, 143, 144, 145, 146, 147, 148, 149, 150, 151, 152, 153, 154, 155, 156 and/or 157.

In one embodiment, the invention provides a single-chain polypeptide fusion protein comprising (or consisting of) an amino acid sequence having at least 80% (such as at least 85, 90, 92, 94, 95, 96, 97, 98, 99 or 100%) sequence identity to the amino acid sequence of SEQ ID NOs:98, 99, 100, 101, 102, 103, 104, 105, 106, 107, 129, 140, 141, 142, 143, 144, 145, 146, 147, 148, 149 and/or 150.

In one embodiment, the invention provides a single-chain polypeptide fusion protein comprising (or consisting of) an amino acid sequence having at least 80% (such as at least 85, 90, 92, 94, 95, 96, 97, 98, 99 or 100%) sequence identity to the amino acid sequence of SEQ ID NOs:111, 112, 113, 132, 133 and/or 134.

In one embodiment, the invention provides a single-chain polypeptide fusion protein comprising (or consisting of) an amino acid sequence having at least 80% (such as at least 85, 90, 92, 94, 95, 96, 97, 98, 99 or 100%) sequence identity to the amino acid sequence of SEQ ID NOs:23, 24, 115, 116, 135, 136, 137 and/or 138.

In one embodiment, the invention provides a single-chain polypeptide fusion protein comprising (or consisting of) an amino acid sequence having at least 80% (such as at least 85, 90, 92, 94, 95, 96, 97, 98, 99 or 100%) sequence identity to the amino acid sequence of SEQ ID NOs:120, 121 and/or 139.

In one embodiment, the invention provides a single-chain polypeptide fusion protein comprising (or consisting of) an amino acid sequence having at least 80% (such as at least 85, 90, 92, 94, 95, 96, 97, 98, 99 or 100%) sequence identity to the amino acid sequence of SEQ ID NO:124 and/or 157.

In one embodiment, the invention provides a single-chain polypeptide fusion protein comprising (or consisting of) an amino acid sequence having at least 80% (such as at least 85, 90, 92, 94, 95, 96, 97, 98, 99 or 100%) sequence identity to the amino acid sequence of SEQ ID NOs:125, 126, 130, 131, 151, 152, 153, 154, 155 and/or 156.

In one embodiment, in the single chain polypeptide, the non-cytotoxic protease component and the translocation component are linked together by a disulphide bond. Thus, following cleavage of the protease cleavage site, the polypeptide assumes a di-chain conformation, wherein the protease and translocation components remain linked together by the disulphide bond. To this end, it is preferred that the protease and translocation components are distanced apart from one another in the single chain fusion protein by a maximum of 100 amino acid residues, more preferably a maximum of 80 amino acid residues, particularly preferably by a maximum of 60 amino acid residues, and most preferably by a maximum of 50 amino acid residues.

In one embodiment, the non-cytotoxic protease component forms a disulphide bond with the translocation component of the fusion protein. For example, the amino acid residue of the protease component that forms the disulphide bond is located within the last 20, preferably within the last 10 C-terminal amino acid residues of the protease component. Similarly, the amino acid residue within the translocation component that forms the second part of the disulphide bond may be located within the first 20, preferably within the first 10 N-terminal amino acid residues of the translocation component.

Alternatively, in the single chain polypeptide, the non-cytotoxic protease component and the TM may be linked together by a disulphide bond. In this regard, the amino acid residue of the TM that forms the disulphide bond is preferably located away from the N-terminus of the TM, more preferably towards to C-terminus of the TM.

In one embodiment, the non-cytotoxic protease component forms a disulphide bond with the TM component of the fusion protein. In this regard, the amino acid residue of the protease component that forms the disulphide bond is preferably located within the last 20, more preferably within the last 10 C-terminal amino acid residues of the protease component. Similarly, the amino acid residue within the TM component that forms the second part of the disulphide bond is preferably located within the last 20, more preferably within the last 10 C-terminal amino acid residues of the TM.

The above disulphide bond arrangements have the advantage that the protease and translocation components are arranged in a manner similar to that for native clostridial neurotoxin. By way of comparison, referring to the primary amino acid sequence for native clostridial neurotoxin, the respective cysteine amino acid residues are distanced apart by between 8 and 27 amino acid residues—taken from Popoff, M R & Marvaud, J-C, 1999, Structural & genomic features of clostridial neurotoxins, Chapter 9, in *The Comprehensive Sourcebook of Bacterial Protein Toxins*. Ed. Alouf & Freer:

| Sero-type[1] | Sequence | 'Native' length between C-C |
|---|---|---|
| BoNT/A1 | CVRGIITSKTKS----LDKGYNKALNDLC | 23 |
| BoNT/A2 | CVRGIIPFKTKS----LDEGYNKALNDLC | 23 |
| BoNT/B | CKSVKAPG------------------IC | 8 |
| BoNT/C | CHKAIDGRS------------LYNKTLDC | 15 |
| BoNT/D | CLRLTK---------------NSRDDSTC | 12 |
| BoNT/E | CKN-IVSVK----------GIRK---SIC | 13 |
| BoNT/F | CKS-VIPRK----------GTKAPP-RLC | 15 |
| BoNT/G | CKPVMYKNT----------GKSE----QC | 13 |
| TeNT | CKKIIPPTNIRENLYNRTASLTDLGGELC | 27 |

[1]Information from proteolytic strains only

The fusion protein may comprise one or more purification tags, which are located N-terminal to the protease component and/or C-terminal to the translocation component.

Whilst any purification tag may be employed, the following are preferred:

His-tag (e.g., 6× histidine), preferably as a C-terminal and/or N-terminal tag

MBP-tag (maltose binding protein), preferably as an N-terminal tag

GST-tag (glutathione-S-transferase), preferably as an N-terminal tag

His-MBP-tag, preferably as an N-terminal tag

GST-MBP-tag, preferably as an N-terminal tag

Thioredoxin-tag, preferably as an N-terminal tag

CBD-tag (Chitin Binding Domain), preferably as an N-terminal tag.

According to a further embodiment of the present invention, one or more peptide spacer molecules may be included in the fusion protein. For example, a peptide spacer may be employed between a purification tag and the rest of the fusion protein molecule (e.g., between an N-terminal purification tag and a protease component of the present invention; and/or between a C-terminal purification tag and a translocation component of the present invention). A peptide spacer may be also employed between the TM and translocation components of the present invention.

A variety of different spacer molecules may be employed in any of the fusion proteins of the present invention. Examples of such spacer molecules include those illustrated in FIGS. 28 and 29. Particular mention here is made to GS15, GS20, GS25, and Hx27—see FIGS. 28 and 29.

The present inventors have unexpectedly found that the fusion proteins (e.g., CPNv/A) of the present invention may demonstrate an improved binding activity for nociceptive sensory afferents when the size of the spacer is selected so that (in use) the C-terminus of the TM and the N-terminus of the translocation component are separated from one another by 40-105 angstroms. In another embodiment, the preferred spacers have an amino acid sequence of 11-29 amino acid residues, preferably 15-27 amino acid residues, and more preferably 20-27 amino acid residues. Suitable spacers may be routinely identified and obtained according to Crasto, C. J. and Feng, J. A., 2000, *Protein Eng.* 13(5):309-312.

In accordance with a second aspect of the present invention, there is provided a DNA sequence that encodes the above-mentioned single chain polypeptide. In a preferred aspect of the present invention, the DNA sequence is prepared as part of a DNA vector, wherein the vector comprises a promoter and terminator.

In a preferred embodiment, the vector has a promoter selected from:

| Promoter | Induction Agent | Typical Induction Condition |
| --- | --- | --- |
| Tac (hybrid) | IPTG | 0.2 mM (0.05-2.0 mM) |
| AraBAD | L-arabinose | 0.2% (0.002-0.4%) |
| T7-lac operator | IPTG | 0.2 mM (0.05-2.0 mM) |

The DNA construct of the present invention is preferably designed in silico, and then synthesised by conventional DNA synthesis techniques.

The above-mentioned DNA sequence information is optionally modified for codon-biasing according to the ultimate host cell (e.g., *E. coli*) expression system that is to be employed.

The DNA backbone is preferably screened for any inherent nucleic acid sequence, which when transcribed and translated would produce an amino acid sequence corresponding to the protease cleave site encoded by the second peptide-coding sequence. This screening may be performed manually or with the assistance of computer software (e.g., the MapDraw program by DNASTAR, Inc.).

According to a further embodiment of the present invention, there is provided a method of preparing a non-cytotoxic agent, comprising:
 a. contacting a single-chain polypeptide fusion protein of the invention with a protease capable of cleaving the protease cleavage site;
 b. cleaving the protease cleavage site, and thereby forming a di-chain fusion protein.

This aspect provides a di-chain polypeptide, which generally mimics the structure of clostridial holotoxin. In more detail, the resulting di-chain polypeptide typically has a structure wherein:

a. the first chain comprises the non-cytotoxic protease, or a fragment thereof, which protease or protease fragment is capable of cleaving a protein of the exocytic fusion apparatus of a nociceptive sensory afferent;
b. the second chain comprises the TM and the translocation domain that is capable of translocating the protease or protease fragment from within an endosome, across the endosomal membrane and into the cytosol of the nociceptive sensory afferent; and the first and second chains are disulphide linked together.

In use, the single chain or di-chain polypeptide of the invention treat, prevent or ameliorate pain.

In use, a therapeutically effective amount of a single chain or di-chain polypeptide of the invention is administered to a patient.

According to a further aspect of the present invention, there is provided use of a single chain or di-chain polypeptide of the invention, for the manufacture of a medicament for treating, preventing or ameliorating pain.

According to a related aspect, there is provided a method of treating, preventing or ameliorating pain in a subject, comprising administering to said patient a therapeutically effective amount of a single chain or di-chain polypeptide of the invention.

The compounds described here may be used to treat a patient suffering from one or more types of chronic pain including neuropathic pain, inflammatory pain, headache pain, somatic pain, visceral pain, and referred pain.

To "treat," as used here, means to deal with medically. It includes, for example, administering a compound of the invention to prevent pain or to lessen its severity.

The term "pain," as used here, means any unpleasant sensory experience, usually associated with a physical disorder. The physical disorder may or may not be apparent to a clinician. Pain is of two types: chronic and acute. An "acute pain" is a pain of short duration having a sudden onset. One type of acute pain, for example, is cutaneous pain felt on injury to the skin or other superficial tissues, such as caused by a cut or a burn. Cutaneous nociceptors terminate just below the skin, and due to the high concentration of nerve endings, produce a well-defined, localized pain of short duration. "Chronic pain" is a pain other than an acute pain. Chronic pain includes neuropathic pain, inflammatory pain, headache pain, somatic pain visceral pain and referred pain.

I. Neuropathic Pain

The compounds of the invention may be used to treat pain caused by or otherwise associated with any of the following neuropathic pain conditions. "Neuropathic pain" means abnormal sensory input, resulting in discomfort, from the peripheral nervous system, central nervous systems, or both.

A. Symptoms of Neuropathic Pain

Symptoms of neuropathic pain can involve persistent, spontaneous pain, as well as allodynia (a painful response to a stimulus that normally is not painful), hyperalgesia (an accentuated response to a painful stimulus that usually causes only a mild discomfort, such as a pin prick), or hyperpathia (where a short discomfort becomes a prolonged severe pain).

B. Causes of Neuropathic Pain

Neuropathic pain may be caused by any of the following.

1. A traumatic insult, such as, for example, a nerve compression injury (e.g., a nerve crush, a nerve stretch, a nerve entrapment or an incomplete nerve transsection); a spinal cord injury (e.g., a hemisection of the spinal cord); a limb amputation; a contusion; an inflammation (e.g., an inflammation of the spinal cord); or a surgical procedure.

2. An ischemic event, including, for example, a stroke and heart attack.

3. An infectious agent

4. Exposure to a toxic agent, including, for example, a drug, an alcohol, a heavy metal (e.g., lead, arsenic, mercury), an industrial agent (e.g., a solvent, fumes from a glue) or nitrous oxide.

5. A disease, including, for example, an inflammatory disorder, a neoplastic tumor, an acquired immune deficiency syndrome (AIDS), Lymes disease, a leprosy, a metabolic disease, a peripheral nerve disorder, like neuroma, a mononeuropathy or a polyneuropathy.

C. Types of Neuropathic Pain

1. Neuralgia.

A neuralgia is a pain that radiates along the course of one or more specific nerves usually without any demonstrable pathological change in the nerve structure. The causes of neuralgia are varied. Chemical irritation, inflammation, trauma (including surgery), compression by nearby structures (for instance, tumors), and infections may all lead to neuralgia. In many cases, however, the cause is unknown or unidentifiable. Neuralgia is most common in elderly persons, but it may occur at any age. A neuralgia, includes, without limitation, a trigeminal neuralgia, a post-herpetic neuralgia, a postherpetic neuralgia, a glossopharyngeal neuralgia, a sciatica and an atypical facial pain.

Neuralgia is pain in the distribution of a nerve or nerves. Examples are trigeminal neuralgia, atypical facial pain, and postherpetic neuralgia (caused by shingles or herpes). The affected nerves are responsible for sensing touch, temperature and pressure in the facial area from the jaw to the forehead. The disorder generally causes short episodes of excruciating pain, usually for less than two minutes and on only one side of the face. The pain can be described in a variety of ways such as "stabbing," "sharp," "like lightning," "burning," and even "itchy". In the atypical form of TN, the pain can also present as severe or merely aching and last for extended periods. The pain associated with TN is recognized as one the most excruciating pains that can be experienced.

Simple stimuli such as eating, talking, washing the face, or any light touch or sensation can trigger an attack (even the sensation of a gentle breeze). The attacks can occur in clusters or as an isolated attack.

Symptoms include sharp, stabbing pain or constant, burning pain located anywhere, usually on or near the surface of the body, in the same location for each episode; pain along the path of a specific nerve; impaired function of affected body part due to pain, or muscle weakness due to concomitant motor nerve damage; increased sensitivity of the skin or numbness of the affected skin area (feeling similar to a local anesthetic such as a Novacaine shot); and any touch or pressure is interpreted as pain. Movement may also be painful.

Trigeminal neuralgia is the most common form of neuralgia. It affects the main sensory nerve of the face, the trigeminal nerve ("trigeminal" literally means "three origins", referring to the division of the nerve into 3 branches). This condition involves sudden and short attacks of severe pain on the side of the face, along the area supplied by the trigeminal nerve on that side. The pain attacks may be severe enough to cause a facial grimace, which is classically referred to as a painful tic (tic douloureux). Sometimes, the cause of trigeminal neuralgia is a blood vessel or small tumor pressing on the nerve. Disorders such as multiple sclerosis (an inflammatory disease affecting the brain and spinal cord), certain forms of arthritis, and diabetes (high blood sugar) may also cause trigeminal neuralgia, but a cause is not always identified. In this condition, certain movements such as chewing, talking, swallowing, or touching an area of the face may trigger a spasm of excruciating pain.

A related but rather uncommon neuralgia affects the glosso-pharyngeal nerve, which provides sensation to the throat. Symptoms of this neuralgia are short, shock-like episodes of pain located in the throat.

Neuralgia may occur after infections such as shingles, which is caused by the varicella-zoster virus, a type of herpesvirus. This neuralgia produces a constant burning pain after the shingles rash has healed. The pain is worsened by movement of or contact with the affected area. Not all of those diagnosed with shingles go on to experience postherpetic neuralgia, which can be more painful than shingles. The pain and sensitivity can last for months or even years. The pain is usually in the form of an intolerable sensitivity to any touch but especially light touch. Postherpetic neuralgia is not restricted to the face; it can occur anywhere on the body but usually occurs at the location of the shingles rash. Depression is not uncommon due to the pain and social isolation during the illness.

Postherpetic neuralgia may be debilitating long after signs of the original herpes infection have disappeared. Other infectious diseases that may cause neuralgia are syphilis and Lyme disease.

Diabetes is another common cause of neuralgia. This very common medical problem affects almost 1 out of every 20 Americans during adulthood. Diabetes damages the tiny arteries that supply circulation to the nerves, resulting in nerve fiber malfunction and sometimes nerve loss. Diabetes can produce almost any neuralgia, including trigeminal neuralgia, carpal tunnel syndrome (pain and numbness of the hand and wrist), and meralgia paresthetica (numbness and pain in the thigh due to damage to the lateral femoral cutaneous nerve). Strict control of blood sugar may prevent diabetic nerve damage and may accelerate recovery in patients who do develop neuralgia.

Other medical conditions that may be associated with neuralgias are chronic renal insufficiency and porphyria—a hereditary disease in which the body cannot rid itself of certain substances produced after the normal breakdown of blood in the body. Certain drugs may also cause this problem.

2. Deafferentation.

Deafferentation indicates a loss of the sensory input from a portion of the body, and can be caused by interruption of either peripheral sensory fibres or nerves from the central nervous system. A deafferentation pain syndrome, includes, without limitation, an injury to the brain or spinal cord, a post-stroke pain, a phantom pain, a paraplegia, a brachial plexus avulsion injuries, lumbar radiculopathies.

3. Complex Regional Pain Syndromes (CRPSs)

CRPS is a chronic pain syndrome resulting from sympathetically-maintained pain, and presents in two forms. CRPS1 currently replaces the term "reflex sympathetic dystrophy syndrome". It is a chronic nerve disorder that occurs most often in the arms or legs after a minor or major injury. CRPS1 is associated with severe pain; changes in the nails, bone, and skin; and an increased sensitivity to touch in the affected limb. CRPS 2 replaces the term causalgia, and results from an identified injury to the nerve. A CRPS, includes, without limitation, a CRPS Type I (reflex sympathetic dystrophy) and a CRPS Type II (causalgia).

4. Neuropathy.

A neuropathy is a functional or pathological change in a nerve and is characterized clinically by sensory or motor neuron abnormalities.

Central neuropathy is a functional or pathological change in the central nervous system.

Peripheral neuropathy is a functional or pathological change in one or more peripheral nerves. The peripheral nerves relay information from your central nervous system (brain and spinal cord) to muscles and other organs and from your skin, joints, and other organs back to your brain. Peripheral neuropathy occurs when these nerves fail to carry information to and from the brain and spinal cord, resulting in pain, loss of sensation, or inability to control muscles. In some cases, the failure of nerves that control blood vessels, intestines, and other organs results in abnormal blood pressure, digestion problems, and loss of other basic body processes. Risk factors for neuropathy include diabetes, heavy alcohol use, and exposure to certain chemicals and drugs. Some people have a hereditary predisposition for neuropathy. Prolonged pressure on a nerve is another risk for developing a nerve injury. Pressure injury may be caused by prolonged immobility (such as a long surgical procedure or lengthy illness) or compression of a nerve by casts, splints, braces, crutches, or other devices. Polyneuropathy implies a widespread process that usually affects both sides of the body equally. The symptoms depend on which type of nerve is affected. The three main types of nerves are sensory, motor, and autonomic. Neuropathy can affect any one or a combination of all three types of nerves. Symptoms also depend on whether the condition affects the whole body or just one nerve (as from an injury). The cause of chronic inflammatory polyneuropathy is an abnormal immune response. The specific antigens, immune processes, and triggering factors are variable and in many cases are unknown. It may occur in association with other conditions such as HIV, inflammatory bowel disease, lupus erythematosis, chronic active hepatitis, and blood cell abnormalities.

Peripheral neuropathy may involve a function or pathological change to a single nerve or nerve group (mononeuropathy) or a function or pathological change affecting multiple nerves (polyneuropathy).

Peripheral Neuropathies
Hereditary Disorders
Charcot-Marie-Tooth disease
Friedreich's ataxia
Systemic or Metabolic Disorders
Diabetes (diabetic neuropathy)
Dietary deficiencies (especially vitamin B-12)
Excessive alcohol use (alcoholic neuropathy)
Uremia (from kidney failure)
Cancer
Infectious or Inflammatory Conditions
AIDS
Hepatitis
Colorado tick fever
diphtheria
Guillain-Barre syndrome
HIV infection without development of AIDS
leprosy
Lyme
polyarteritis nodosa
rheumatoid arthritis
sarcoidosis
Sjogren syndrome
syphilis
systemic lupus erythematosus
amyloid
Exposure to Toxic Compounds
sniffing glue or other toxic compounds
nitrous oxide
industrial agents—especially solvents
heavy metals (lead, arsenic, mercury, etc.)
Neuropathy secondary to drugs like analgesic nephropathy
Miscellaneous Causes
ischemia (decreased oxygen/decreased blood flow)
prolonged exposure to cold temperature a. Polyneuropathy Polyneuropathy is a peripheral neuropathy involving the loss of movement or sensation to an area caused by damage or destruction to multiple peripheral nerves. Polyneuropathic pain, includes, without limitation, post-polio syndrome, post-mastectomy syndrome, diabetic neuropathy, alcohol neuropathy, amyloid, toxins, AIDS, hypothyroidism, uremia, vitamin deficiencies, chemotherapy-induced pain, 2',3'-didexoycytidine (ddC) treatment, Guillain-Barré syndrome or Fabry's disease.

b. Mononeuropathy

Mononeuropathy is a peripheral neuropathy involving loss of movement or sensation to an area caused by damage or destruction to a single peripheral nerve or nerve group. Mononeuropathy is most often caused by damage to a local area resulting from injury or trauma, although occasionally systemic disorders may cause isolated nerve damage (as with mononeuritis multiplex). The usual causes are direct trauma, prolonged pressure on the nerve, and compression of the nerve by swelling or injury to nearby body structures. The damage includes destruction of the myelin sheath (covering) of the nerve or of part of the nerve cell (the axon). This damage slows or prevents conduction of impulses through the nerve. Mononeuropathy may involve any part of the body. Mononeuropathic pain, includes, without limitation, a sciatic nerve dysfunction, a common peroneal nerve dysfunction. a radial nerve dysfunction, an ulnar nerve dysfunction, a cranial mononeuropathy VI, a cranial mononeuropathy VII, a cranial mononeuropathy III (compression type), a cranial mononeuropathy III (diabetic type), an axillary nerve dysfunction, a carpal tunnel syndrome, a femoral nerve dysfunction, a tibial nerve dysfunction, a Bell's palsy, a thoracic outlet syndrome, a carpal tunnel syndrome and a sixth (abducent) nerve palsy c. Generalized Peripheral Neuropathies Generalized peripheral neuropathies are symmetrical, and usually due to various systematic illnesses and disease processes that affect the peripheral nervous system in its entirety. They are further subdivided into several categories:

i. Distal axonopathies are the result of some metabolic or toxic derangement of neurons. They may be caused by metabolic diseases such as diabetes, renal failure, deficiency syndromes such as malnutrition and alcoholism, or the effects of toxins or drugs. Distal axonopathy (aka dying back neuropathy) is a type of peripheral neuropathy that results from some metabolic or toxic derangement of peripheral nervous system (PNS) neurons. It is the most common response of nerves to metabolic or toxic disturbances, and as such may be caused by metabolic diseases such as diabetes, renal failure, deficiency syndromes such as malnutrition and alcoholism, or the effects of toxins or drugs. The most common cause of distal axonopathy is diabetes, and the most common distal axonopathy is diabetic neuropathy.

ii. Myelinopathies are due to a primary attack on myelin causing an acute failure of impulse conduction. The most common cause is acute inflammatory demyelinating polyneuropathy (AIDP; aka Guillain-Barré syndrome), though other causes include chronic inflammatory demyelinating syndrome (CIDP), genetic metabolic disorders (e.g., leukodystrophy), or toxins. Myelinopathy is due to primary destruction of myelin or the myelinating Schwann cells, which leaves the axon intact, but causes an acute failure of impulse conduction. This demyelination slows down or completely blocks the conduction of electrical impulses through the nerve. The most common cause is acute inflammatory demyelinating polyneuropathy (AIDP, better known as Guillain-Barré syndrome), though other causes include chronic inflammatory demyelinating polyneuropathy (CIDP), genetic metabolic disorders (e.g., leukodystrophy or Charcot-Marie-Tooth disease), or toxins.

iii. Neuronopathies are the result of destruction of peripheral nervous system (PNS) neurons. They may be caused by motor neurone diseases, sensory neuronopathies (e.g., Herpes zoster), toxins or autonomic dysfunction. Neurotoxins may cause neuronopathies, such as the chemotherapy agent vincristine. Neuronopathy is dysfunction due to damage to neurons of the peripheral nervous system (PNS), resulting in a peripheral neuropathy. It may be caused by motor neurone diseases, sensory neuronopathies (e.g., Herpes zoster), toxic substances or autonomic dysfunction. A person with neuronopathy may present in different ways, depending on the cause, the way it affects the nerve cells, and the type of nerve cell that is most affected.

iv. Focal entrapment neuropathies (e.g., carpal tunnel syndrome).

II. Inflammatory Pain

The compounds of the invention may be used to treat pain caused by or otherwise associated with any of the following inflammatory conditions.

A. Arthritic disorder

Arthritic disorders include, for example, a rheumatoid arthritis; a juvenile rheumatoid arthritis; a systemic lupus erythematosus (SLE); a gouty arthritis; a scleroderma; an osteoarthritis; a psoriatic arthritis; an ankylosing spondylitis; a Reiter's syndrome (reactive arthritis); an adult Still's disease; an arthritis from a viral infection; an arthritis from a bacterial infection, such as, e.g., a gonococcal arthritis and a non-gonococcal bacterial arthritis (septic arthritis); a Tertiary Lyme disease; a tuberculous arthritis; and an arthritis from a fungal infection, such as, e.g., a blastomycosis B. Autoimmune Diseases Autoimmune diseases include, for example, a Guillain-Barré syndrome, a Hashimoto's thyroiditis, a pernicious anemia, an Addison's disease, a type I diabetes, a systemic lupus erythematosus, a dermatomyositis, a Sjogren's syndrome, a lupus erythematosus, a multiple sclerosis, a myasthenia gravis, a Reiter's syndrome and a Grave's disease.

C. Connective Tissue Disorder

Connective tissue disorders include, for example, a spondyloarthritis a dermatomyositis, and a fibromyalgia.

D. Injury

Inflammation caused by injury, including, for example, a crush, puncture, stretch of a tissue or joint, may cause chronic inflammatory pain.

E. Infection

Inflammation caused by infection, including, for example, a tuberculosis or an interstitial keratitis may cause chronic inflammatory pain.

F. Neuritis

Neuritis is an inflammatory process affecting a nerve or group of nerves. Symptoms depend on the nerves involved, but may include pain, paresthesias, paresis, or hypesthesia (numbness).

Examples include:
a. Brachial neuritis
b. Retrobulbar neuropathy, an inflammatory process affecting the part of the optic nerve lying immediately behind the eyeball.
c. Optic neuropathy, an inflammatory process affecting the optic nerve causing sudden, reduced vision in the affected eye. The cause of optic neuritis is unknown. The sudden inflammation of the optic nerve (the nerve connecting the eye and the brain) leads to swelling and destruction of the myelin sheath. The inflammation may occasionally be the result of a viral infection, or it may be caused by autoimmune diseases such as multiple sclerosis. Risk factors are related to the possible causes.
d. Vestibular neuritis, a viral infection causing an inflammatory process affecting the vestibular nerve.

G. Joint Inflammation

Inflammation of the joint, such as that caused by bursitis or tendonitis, for example, may cause chronic inflammatory pain.

III. Headache Pain

The compounds of the invention may be used to treat pain caused by or otherwise associated with any of the following headache conditions. A headache (medically known as cephalgia) is a condition of mild to severe pain in the head; sometimes neck or upper back pain may also be interpreted as a headache. It may indicate an underlying local or systemic disease or be a disorder in itself.

A. Muscular/Myogenic Headache

Muscular/myogenic headaches appear to involve the tightening or tensing of facial and neck muscles; they may radiate to the forehead. Tension headache is the most common form of myogenic headache.

A tension headache is a condition involving pain or discomfort in the head, scalp, or neck, usually associated with muscle tightness in these areas. Tension headaches result from the contraction of neck and scalp muscles. One cause of this muscle contraction is a response to stress, depression or anxiety. Any activity that causes the head to be held in one position for a long time without moving can cause a headache. Such activities include typing or use of computers, fine work with the hands, and use of a microscope. Sleeping in a cold room or sleeping with the neck in an abnormal position may also trigger this type of headache. A tension-type headache, includes, without limitation, an episodic tension headache and a chronic tension headache.

B. Vascular Headache

The most common type of vascular headache is migraine. Other kinds of vascular headaches include cluster headaches, which cause repeated episodes of intense pain, and headaches resulting from high blood pressure 1. Migraine A migraine is a heterogeneous disorder that generally involves recurring headaches. Migraines are different from other headaches because they occur with other symptoms, such as, e.g., nausea, vomiting, or sensitivity to light. In most people, a throbbing pain is felt only on one side of the head. Clinical features such as type of aura symptoms, presence of prodromes, or associated symptoms such as vertigo, may be seen in subgroups of patients with different underlying pathophysiological and genetic mechanisms. A migraine headache, includes, without limitation, a migraine without aura (common migraine), a migraine with aura (classic migraine), a menstrual migraine, a migraine equivalent (acephalic headache), a complicated migraine, an abdominal migraine and a mixed tension migraine.

2. Cluster Headache

Cluster headaches affect one side of the head (unilateral) and may be associated with tearing of the eyes and nasal congestion. They occurs in clusters, happening repeatedly every day at the same time for several weeks and then remitting.

D. High Blood Pressure Headache

E. Traction and Inflammatory Headache

Traction and inflammatory headaches are usually symptoms of other disorders, ranging from stroke to sinus infection.

F. Hormone Headache

G. Rebound Headache

Rebound headaches, also known as medication overuse headaches, occur when medication is taken too frequently to relieve headache. Rebound headaches frequently occur daily and can be very painful.

H. Chronic Sinusitis Headache

Sinusitis is inflammation, either bacterial, fungal, viral, allergic or autoimmune, of the paranasal sinuses. Chronic sinusitis is one of the most common complications of the common cold. Symptoms include: Nasal congestion; facial pain; headache; fever; general malaise; thick green or yellow discharge; feeling of facial 'fullness' worsening on bending over. In a small number of cases, chronic maxillary sinusitis can also be brought on by the spreading of bacteria from a dental infection. Chronic hyperplastic eosinophilic sinusitis is a noninfective form of chronic sinusitis.

I. An Organic Headache

J. Ictal Headaches

Ictal headaches are headaches associated with seizure activity.

IV. Somatic Pain

The compounds of the invention may be used to treat pain caused by or otherwise associated with any of the following somatic pain conditions. Somatic pain originates from ligaments, tendons, bones, blood vessels, and even nerves themselves. It is detected with somatic nociceptors. The scarcity of pain receptors in these areas produces a dull, poorly-localized pain of longer duration than cutaneous pain; examples include sprains and broken bones. Additional examples include the following.

A. Excessive Muscle Tension

Excessive muscle tension can be caused, for example, by a sprain or a strain.

B. Repetitive Motion Disorders

Repetitive motion disorders can result from overuse of the hands, wrists, elbows, shoulders, neck, back, hips, knees, feet, legs, or ankles.

C. Muscle Disorders

Muscle disorders causing somatic pain include, for example, a polymyositis, a dermatomyositis, a lupus, a fibromyalgia, a polymyalgia rheumatica, and a rhabdomyolysis.

D. Myalgia

Myalgia is muscle pain and is a symptom of many diseases and disorders. The most common cause for myalgia is either overuse or over-stretching of a muscle or group of muscles. Myalgia without a traumatic history is often due to viral infections. Longer-term myalgias may be indicative of a metabolic myopathy, some nutritional deficiencies or chronic fatigue syndrome.

E. Infection

Infection can cause somatic pain. Examples of such infection include, for example, an abscess in the muscle, a trichinosis, an influenza, a Lyme disease, a malaria, a Rocky Mountain spotted fever, Avian influenza, the common cold, community-acquired pneumonia, meningitis, monkeypox, Severe Acute Respiratory Syndrome, toxic shock syndrome, trichinosis, typhoid fever, and upper respiratory tract infection.

F. Drugs

Drugs can cause somatic pain. Such drugs include, for example, cocaine, a statin for lowering cholesterol (such as atorvastatin, simvastatin, and lovastatin), and an ACE inhibitor for lowering blood pressure (such as enalapril and captopril)

V. Visceral Pain

The compounds of the invention may be used to treat pain caused by or otherwise associated with any of the following visceral pain conditions. Visceral pain originates from body's viscera, or organs. Visceral nociceptors are located within body organs and internal cavities. The even greater scarcity of nociceptors in these areas produces pain that is usually more aching and of a longer duration than somatic pain. Visceral pain is extremely difficult to localise, and several injuries to visceral tissue exhibit "referred" pain, where the sensation is localised to an area completely unrelated to the site of injury. Examples of visceral pain include the following.

A. Functional Visceral Pain

Functional visceral pain includes, for example, an irritable bowel syndrome and a chronic functional abdominal pain (CFAP), a functional constipation and a functional dyspepsia, a non-cardiac chest pain (NCCP) and a chronic abdominal pain.

B. Chronic Gastrointestinal Inflammation

Chronic gastrointestinal inflammation includes, for example, a gastritis, an inflammatory bowel disease, like, e.g., a Crohn's disease, an ulcerative colitis, a microscopic colitis, a diverticulitis and a gastroenteritis; an interstitial cystitis; an intestinal ischemia; a cholecystitis; an appendicitis; a gastroesophageal reflux; an ulcer, a nephrolithiasis, a urinary tract infection, a pancreatitis and a hernia.

C. Autoimmune Pain

Autoimmune pain includes, for example, a sarcoidosis and a vasculitis.

D. Organic Visceral Pain

Organic visceral pain includes, for example, pain resulting from a traumatic, inflammatory or degenerative lesion of the gut or produced by a tumor impinging on sensory innervation.

E. Treatment-Induced Visceral Pain

Treatment-induced visceral pain includes, for example, a pain attendant to chemotherapy therapy or a pain attendant to radiation therapy.

VI. Referred Pain

The compounds of the invention may be used to treat pain caused by or otherwise associated with any of the following referred pain conditions.

Referred pain arises from pain localized to an area separate from the site of pain stimulation. Often, referred pain arises when a nerve is compressed or damaged at or near its origin. In this circumstance, the sensation of pain will generally be felt in the territory that the nerve serves, even though the damage originates elsewhere. A common example occurs in intervertebral disc herniation, in which a nerve root arising from the spinal cord is compressed by adjacent disc material. Although pain may arise from the damaged disc itself, pain will also be felt in the region served by the compressed nerve (for example, the thigh, knee, or foot). Relieving the pressure on the nerve root may ameliorate the referred pain, provided that permanent nerve damage has not occurred. Myocardial ischaemia (the loss of blood flow to a part of the heart muscle tissue) is possibly the best known example of referred pain; the sensation can occur in the upper chest as a restricted feeling, or as an ache in the left shoulder, arm or even hand.

The present invention addresses a wide range of pain conditions, in particular chronic pain conditions. Preferred conditions include cancerous and non-cancerous pain, inflammatory pain and neuropathic pain. The opioid-fusions of the present application are particularly suited to addressing inflammatory pain, though may be less suited to addressing neuropathic pain. The galanin-fusions are more suited to addressing neuropathic pain.

In use, the polypeptides of the present invention are typically employed in the form of a pharmaceutical composition in association with a pharmaceutical carrier, diluent and/or excipient, although the exact form of the composition may be tailored to the mode of administration. Administration is preferably to a mammal, more preferably to a human.

The polypeptides may, for example, be employed in the form of a sterile solution for intra-articular administration or intra-cranial administration. Spinal injection (e.g., epidural or intrathecal) is preferred.

The dosage ranges for administration of the polypeptides of the present invention are those to produce the desired therapeutic effect. It will be appreciated that the dosage range required depends on the precise nature of the components, the route of administration, the nature of the formulation, the age of the patient, the nature, extent or severity of the patient's condition, contraindications, if any, and the judgement of the attending physician.

Suitable daily dosages are in the range 0.0001-1 mg/kg, preferably 0.0001-0.5 mg/kg, more preferably 0.002-0.5 mg/kg, and particularly preferably 0.004-0.5 mg/kg. The unit dosage can vary from less that 1 microgram to 30 mg, but typically will be in the region of 0.01 to 1 mg per dose, which may be administered daily or preferably less frequently, such as weekly or six monthly.

A particularly preferred dosing regimen is based on 2.5 ng of fusion protein (e.g., CPNv/A) as the 1× dose. In this regard, preferred dosages are in the range 1×-100× (i.e., 2.5-250 ng). This dosage range is significantly lower (i.e., at least 10-fold, typically 100-fold lower) than would be employed with other types of analgesic molecules such as NSAIDS, morphine, and gabapentin. Moreover, the above-mentioned difference is considerably magnified when the same comparison is made on a molar basis—this is because the fusion proteins of the present invention have a considerably greater Mw than do conventional 'small' molecule therapeutics.

Wide variations in the required dosage, however, are to be expected depending on the precise nature of the components, and the differing efficiencies of various routes of administration.

Variations in these dosage levels can be adjusted using standard empirical routines for optimisation, as is well understood in the art.

Compositions suitable for injection may be in the form of solutions, suspensions or emulsions, or dry powders which are dissolved or suspended in a suitable vehicle prior to use.

Fluid unit dosage forms are typically prepared utilising a pyrogen-free sterile vehicle. The active ingredients, depending on the vehicle and concentration used, can be either dissolved or suspended in the vehicle.

In preparing administrable solutions, the polypeptides can be dissolved in a vehicle, the solution being made isotonic if necessary by addition of sodium chloride and sterilised by filtration through a sterile filter using aseptic techniques before filling into suitable sterile vials or ampoules and sealing. Alternatively, if solution stability is adequate, the solution in its sealed containers may be sterilised by autoclaving.

Advantageously additives such as buffering, solubilising, stabilising, preservative or bactericidal, suspending or emulsifying agents may be dissolved in the vehicle.

Dry powders which are dissolved or suspended in a suitable vehicle prior to use may be prepared by filling pre-sterilised drug substance and other ingredients into a sterile container using aseptic technique in a sterile area.

Alternatively the polypeptides and other ingredients may be dissolved in an aqueous vehicle, the solution is sterilized by filtration and distributed into suitable containers using aseptic technique in a sterile area. The product is then freeze dried and the containers are sealed aseptically.

Parenteral suspensions, suitable for intramuscular, subcutaneous or intradermal injection, are prepared in substantially the same manner, except that the sterile components are suspended in the sterile vehicle, instead of being dissolved and sterilisation cannot be accomplished by filtration. The components may be isolated in a sterile state or alternatively it may be sterilised after isolation, e.g., by gamma irradiation.

Advantageously, a suspending agent for example polyvinylpyrrolidone is included in the composition/s to facilitate uniform distribution of the components.

DEFINITIONS SECTION

Targeting Moiety (TM) means any chemical structure associated with an agent that functionally interacts with a Binding Site to cause a physical association between the agent and the surface of a target cell. In the context of the present invention, the target cell is a nociceptive sensory afferent. The term TM embraces any molecule (i.e., a naturally occurring molecule, or a chemically/physically modified variant thereof) that is capable of binding to a Binding Site on the target cell, which Binding Site is capable of internalisation (e.g., endosome formation)—also referred to as receptor-mediated endocytosis. The TM may possess an endosomal membrane translocation function, in which case separate TM and Translocation Domain components need not be present in an agent of the present invention.

The TM of the present invention binds (preferably specifically binds) to a nociceptive sensory afferent (e.g., a primary nociceptive afferent). In this regard, specifically binds means that the TM binds to a nociceptive sensory afferent (e.g., a primary nociceptive afferent) with a greater affinity than it binds to other neurons such as non-nociceptive afferents, and/or to motor neurons (i.e., the natural target for clostridial neurotoxin holotoxin). The term "specifically binding" can also mean that a given TM binds to a given receptor, for example Mrg receptors such as MrgX1, opioid receptors such as OPRD1 and/or OPRM1, BDKRB1 and/or BDKRB2, Tachykinin receptors such as TACR1, TACR2 and/or TACR3, Kappa receptor (OPRK1) and/or ORL$_1$ receptor, with a binding affinity ($K_a$) of $10^6$ M$^{-1}$ or greater, preferably $10^7$ M$^{-1}$ or greater, more preferably $10^8$M$^{-1}$ or greater, and most preferably, $10^9$M$^{-1}$ or greater.

For the purposes of this invention, an agonist is defined as a molecule that is capable of stimulating the process of exocytic fusion in a target cell, which process is susceptible to inhibition by a protease (or fragment thereof) capable of cleaving a protein of the exocytic fusion apparatus in said target cell.

Accordingly, the particular agonist definition of the present invention would exclude many molecules that would be conventionally considered as agonists.

For example, nerve growth factor (NGF) is an agonist in respect of its ability to promote neuronal differentiation via binding to a TrkA receptor. However, NGF is not an agonist when assessed by the above criteria because it is not a principal inducer of exocytic fusion. In addition, the process that NGF stimulates (i.e., cell differentiation) is not susceptible to inhibition by the protease activity of a non-cytotoxic toxin molecule.

The term "fragment", when used in relation to a protein, means a peptide having at least thirty-five, preferably at least twenty-five, more preferably at least twenty, and most preferably at least 19, 18, 17, 16, 15, 14, 13, 12, 11, 10, 9, 8, 7, 6 or 5 amino acid residues of the protein in question.

The term "variant", when used in relation to a protein, means a peptide or peptide fragment of the protein that contains one or more analogues of an amino acid (e.g., an unnatural amino acid), or a substituted linkage.

The term "derivative", when used in relation to a protein, means a protein that comprises the protein in question, and a further peptide sequence. The further peptide sequence should preferably not interfere with the basic folding and thus conformational structure of the original protein. Two or more peptides (or fragments, or variants) may be joined together to form a derivative. Alternatively, a peptide (or fragment, or variant) may be joined to an unrelated molecule (e.g., a second, unrelated peptide). Derivatives may be chemically synthesized, but will be typically prepared by recombinant nucleic acid methods. Additional components such as lipid, and/or polysaccharide, and/or polypeptide components may be included.

Throughout this specification, reference to the "ORL$_1$ receptor" embraces all members of the ORL$_1$ receptor family. Members of the ORL$_1$ receptor family typically have a seven transmembrane domain structure and are coupled to G-proteins of the G$_i$ and G$_o$ families. A method for determining the G-protein-stimulating activity of ligands of the ORL$_1$ receptor is given in Example 12. A method for measuring reduction in cellular cAMP levels following ORL$_1$ activation is given in Example 11. A further characteristic of members of the ORL$_1$ receptor family is that they are typically able to bind nociceptin (the natural ligand of ORL$_1$). As an example, all alternative splice variants of the ORL$_1$ receptor, are members of the ORL$_1$ receptor family.

The term non-cytotoxic means that the protease molecule in question does not kill the target cell to which it has been re-targeted.

The protease of the present invention embraces all naturally-occurring non-cytotoxic proteases that are capable of cleaving one or more proteins of the exocytic fusion apparatus in eukaryotic cells.

The protease of the present invention is preferably a bacterial protease (or fragment thereof). More preferably the bacterial protease is selected from the genera *Clostridium* or *Neisseria* (e.g., a clostridial L-chain, or a neisserial IgA protease preferably from *N. gonorrhoeae*).

The present invention also embraces modified non-cytotoxic proteases, which include amino acid sequences that do not occur in nature and/or synthetic amino acid residues, so long as the modified proteases still demonstrate the above-mentioned protease activity.

The protease of the present invention preferably demonstrates a serine or metalloprotease activity (e.g., endopeptidase activity). The protease is preferably specific for a SNARE protein (e.g., SNAP-25, synaptobrevin/VAMP, or syntaxin).

Particular mention is made to the protease domains of neurotoxins, for example the protease domains of bacterial neurotoxins. Thus, the present invention embraces the use of neurotoxin domains, which occur in nature, as well as recombinantly prepared versions of said naturally-occurring neurotoxins.

Exemplary neurotoxins are produced by clostridia, and the term clostridial neurotoxin embraces neurotoxins produced by *C. tetani* (TeNT), and by *C. botulinum* (BoNT) serotypes A-G, as well as the closely related BoNT-like neurotoxins produced by *C. baratii* and *C. butyricum*. The above-mentioned abbreviations are used throughout the present specification. For example, the nomenclature BoNT/A denotes the source of neurotoxin as BoNT (serotype A). Corresponding nomenclature applies to other BoNT serotypes.

The term L-chain fragment means a component of the L-chain of a neurotoxin, which fragment demonstrates a metalloprotease activity and is capable of proteolytically cleaving a vesicle and/or plasma membrane associated protein involved in cellular exocytosis.

A Translocation Domain is a molecule that enables translocation of a protease (or fragment thereof) into a target cell such that a functional expression of protease activity occurs within the cytosol of the target cell. Whether any molecule (e.g., a protein or peptide) possesses the requisite translocation function of the present invention may be confirmed by any one of a number of conventional assays.

For example, Shone C. (1987) describes an in vitro assay employing liposomes, which are challenged with a test molecule. Presence of the requisite translocation function is confirmed by release from the liposomes of K$^+$ and/or labelled NAD, which may be readily monitored (see Shone C., 1987, *Eur. J. Biochem,* 167(1):175-180).

A further example is provided by Blaustein R. (1987), which describes a simple in vitro assay employing planar phospholipid bilayer membranes. The membranes are challenged with a test molecule and the requisite translocation function is confirmed by an increase in conductance across said membranes (see Blaustein, 1987, *FEBS Letts,* 226(1): 115-120).

Additional methodology to enable assessment of membrane fusion and thus identification of Translocation Domains suitable for use in the present invention are provided by *Methods in Enzymology Vols.* 220 and 221, Membrane Fusion Techniques, Parts A and B, Academic Press, 1993.

The Translocation Domain is preferably capable of formation of ion-permeable pores in lipid membranes under conditions of low pH. Preferably it has been found to use only those portions of the protein molecule capable of pore-formation within the endosomal membrane.

The Translocation Domain may be obtained from a microbial protein source, in particular from a bacterial or viral protein source. Hence, in one embodiment, the Translocation Domain is a translocating domain of an enzyme, such as a bacterial toxin or viral protein.

It is well documented that certain domains of bacterial toxin molecules are capable of forming such pores. It is also known that certain translocation domains of virally expressed membrane fusion proteins are capable of forming such pores. Such domains may be employed in the present invention.

The Translocation Domain may be of a clostridial origin, namely the H$_N$ domain (or a functional component thereof). H$_N$ means a portion or fragment of the H-chain of a clostridial neurotoxin approximately equivalent to the amino-terminal half of the H-chain, or the domain corresponding to that fragment in the intact H-chain. It is preferred that the H-chain substantially lacks the natural binding function of the H$_C$ component of the H-chain. In this regard, the H$_C$ function may be removed by deletion of the H$_C$ amino acid sequence (either at the DNA synthesis level, or at the post-synthesis level by nuclease or protease treatment). Alternatively, the H$_C$ function may be inactivated by chemical or biological treatment. Thus, the H-chain is preferably incapable of binding to the Binding Site on a target cell to which native clostridial neurotoxin (i.e., holotoxin) binds.

In one embodiment, the translocation domain is a H$_N$ domain (or a fragment thereof) of a clostridial neurotoxin. Examples of suitable clostridial Translocation Domains include:

Botulinum type A neurotoxin—amino acid residues (449-871)
Botulinum type B neurotoxin—amino acid residues (441-858)
Botulinum type C neurotoxin—amino acid residues (442-866)
Botulinum type D neurotoxin—amino acid residues (446-862)
Botulinum type E neurotoxin—amino acid residues (423-845)
Botulinum type F neurotoxin—amino acid residues (440-864)
Botulinum type G neurotoxin—amino acid residues (442-863)
Tetanus neurotoxin—amino acid residues (458-879)

For further details on the genetic basis of toxin production in *Clostridium botulinum* and *C. tetani*, we refer to Henderson et al. (1997) in *The Clostridia: Molecular Biology and Pathogenesis*, Academic Press.

The term $H_N$ embraces naturally-occurring neurotoxin $H_N$ portions, and modified $H_N$ portions having amino acid sequences that do not occur in nature and/or synthetic amino acid residues, so long as the modified $H_N$ portions still demonstrate the above-mentioned translocation function.

Alternatively, the Translocation Domain may be of a non-clostridial origin (see Table 4). Examples of non-clostridial Translocation Domain origins include, but not be restricted to, the translocation domain of diphtheria toxin (O'Keefe et al., *Proc. Natl. Acad. Sci. USA* (1992) 89:6202-6206; Silverman et al., *J. Biol. Chem.* (1993) 269:22524-22532; and London, E., *Biochem. Biophys. Acta.* (1992) 1112:25-51), the translocation domain of *Pseudomonas* exotoxin type A (Prior et al., *Biochemistry* (1992) 31:3555-3559), the translocation domains of anthrax toxin (Blanke et al., *Proc. Natl. Acad. Sci. USA* (1996) 93:8437-8442), a variety of fusogenic or hydrophobic peptides of translocating function (Plank et al., *J. Biol. Chem.* (1994) 269:12918-12924; and Wagner et al., *Proc. Natl. Acad. Sci. USA* (1992) 89:7934-7938), and amphiphilic peptides (Murata et al., *Biochemistry* (1992) 31:1986-1992). The Translocation Domain may mirror the Translocation Domain present in a naturally-occurring protein, or may include amino acid variations so long as the variations do not destroy the translocating ability of the Translocation Domain.

Particular examples of viral Translocation Domains suitable for use in the present invention include certain translocating domains of virally expressed membrane fusion proteins. For example, Wagner et al. (1992) supra and Murata et al. (1992) supra describe the translocation (i.e., membrane fusion and vesiculation) function of a number of fusogenic and amphiphilic peptides derived from the N-terminal region of influenza virus haemagglutinin. Other virally expressed membrane fusion proteins known to have the desired translocating activity are a translocating domain of a fusogenic peptide of Semliki Forest Virus (SFV), a translocating domain of vesicular stomatitis virus (VSV) glycoprotein G, a translocating domain of SER virus F protein and a translocating domain of Foamy virus envelope glycoprotein. Virally encoded Aspike proteins have particular application in the context of the present invention, for example, the E1 protein of SFV and the G protein of the G protein of VSV.

Use of the Translocation Domains listed in Table (below) includes use of sequence variants thereof. A variant may comprise one or more conservative nucleic acid substitutions and/or nucleic acid deletions or insertions, with the proviso that the variant possesses the requisite translocating function. A variant may also comprise one or more amino acid substitutions and/or amino acid deletions or insertions, so long as the variant possesses the requisite translocating function.

| Translocation domain source | Amino acid residues | References |
| --- | --- | --- |
| Diphtheria toxin | 194-380 | Silverman et al., 1994, *J. Biol. Chem.* 269: 22524-22532 |
| | | London E., 1992, *Biochem. Biophys. Acta* 1113: 25-51 |
| Domain II of pseudomonas exotoxin | 405-613 | Prior et al., 1992, *Biochemistry* 31: 3555-3559 Kihara & Pastan, 1994, *Bioconj. Chem.* 5: 532-538 |
| Influenza virus haemagglutinin | GLFGAIAGFIENGWEG MIDGWYG, (SEQ ID NO: 163, and Variants thereof | Plank et al., 1994, *J. Biol. Chem.* 269: 12918-12924 Wagner et al., 1992, *PNAS* 89: 7934-7938 Murata et al., 1992, *Biochemistry* 31: 1986-1992 |
| Semliki Forest virus fusogenic protein | Translocation domain | Kielian et al., 1996, *J. Cell Biol.* 134(4): 863-872 |
| Vesicular Stomatitis virus glycoprotein G | 118-139 | Yao et al., 2003, *Virology* 310(2): 319-332 |
| SER virus F protein | Translocation domain | Seth et al., 2003, *J. Virol.* 77(11): 6520-6527 |
| Foamy virus envelope glycoprotein | Translocation domain | Picard-Maureau et al., 2003, *J. Virol.* 77(8): 4722-4730 |

SEQ ID NOS

Where an initial Met amino acid residue or a corresponding initial codon is indicated in any of the following SEQ ID NOs, said residue/codon is optional.

SEQ ID NO:1 DNA sequence of the LC/A
SEQ ID NO:2 DNA sequence of the $H_N$/A
SEQ ID NO:3 DNA sequence of the LC/B
SEQ ID NO:4 DNA sequence of the $H_N$/B
SEQ ID NO:5 DNA sequence of the LC/C
SEQ ID NO:6 DNA sequence of the $H_N$/C
SEQ ID NO:7 DNA sequence of the CPN-A linker
SEQ ID NO:8 DNA sequence of the A linker
SEQ ID NO:9 DNA sequence of the N-terminal presentation nociceptin insert
SEQ ID NO:10 DNA sequence of the CPN-C linker
SEQ ID NO:11 DNA sequence of the CPBE-A linker
SEQ ID NO:12 DNA sequence of the CPNvar-A linker
SEQ ID NO:13 DNA sequence of the LC/A-CPN-$H_N$/A fusion
SEQ ID NO:14 Protein sequence of the LC/A-CPN-$H_N$/A fusion
SEQ ID NO:15 DNA sequence of the N-LC/A-$H_N$/A fusion
SEQ ID NO:16 Protein sequence of the N-LC/A-$H_N$/A fusion
SEQ ID NO:17 DNA sequence of the LC/C-CPN-$H_N$/C fusion
SEQ ID NO:18 Protein sequence of the LC/C-CPN-$H_N$/C fusion
SEQ ID NO:19 DNA sequence of the LC/C-CPN-$H_N$/C (A-linker) fusion
SEQ ID NO:20 Protein sequence of the LC/C-CPN-$H_N$/C (A-linker) fusion
SEQ ID NO:21 DNA sequence of the LC/A-CPME-$H_N$/A fusion
SEQ ID NO:22 Protein sequence of the LC/A-CPME-$H_N$/A fusion
SEQ ID NO:23 DNA sequence of the LC/A-CPBE-$H_N$/A fusion
SEQ ID NO:24 Protein sequence of the LC/A-CPBE-$H_N$/A fusion
SEQ ID NO:25 DNA sequence of the LC/A-CPNv-$H_N$/A fusion
SEQ ID NO:26 Protein sequence of the LC/A-CPNv-$H_N$/A fusion SEQ ID NO:27 DNA sequence of the LC/A-CPN[1-11]-HN/A fusion
SEQ ID NO:28 Protein sequence of the LC/A-CPN[1-11]-HN/A fusion
SEQ ID NO:29 DNA sequence of the LC/A-CPN[[Y10]1-11]-HN/A fusion
SEQ ID NO:30 Protein sequence of the LC/A-CPN[[Y10]1-11]-HN/A fusion
SEQ ID NO:31 DNA sequence of the LC/A-CPN[[Y11]1-11]-HN/A fusion
SEQ ID NO:32 Protein sequence of the LC/A-CPN[[Y11]1-11]-HN/A fusion
SEQ ID NO:33 DNA sequence of the LC/A-CPN[[Y14]1-17]-HN/A fusion
SEQ ID NO:34 Protein sequence of the LC/A-CPN[[Y14]1-17]-HN/A fusion
SEQ ID NO:35 DNA sequence of the LC/A-CPN[1-13]-HN/A fusion
SEQ ID NO:36 Protein sequence of the LC/A-CPN[1-13]-HN/A fusion
SEQ ID NO:37 DNA sequence of CPN[1-17]
SEQ ID NO:38 Protein Sequence of CPN[1-17]
SEQ ID NO:39 DNA sequence of CPN[1-11]
SEQ ID NO:40 Protein sequence of CPN[1-11]
SEQ ID NO:41 DNA sequence of CPN[[Y10]1-11]
SEQ ID NO:42 Protein sequence of CPN[[Y10]1-11]
SEQ ID NO:43 DNA sequence of CPN[[Y11]1-11]
SEQ ID NO:44 Protein sequence of CPN[[Y11]1-11]
SEQ ID NO:45 DNA sequence of CPN[[Y14]1-17]
SEQ ID NO:46 Protein sequence of CPN[[Y14]1-17]
SEQ ID NO:47 DNA sequence of CPN[1-13]
SEQ ID NO:48 Protein sequence of CPN[1-13]
SEQ ID NO:49 DNA sequence of CPNv (also known as N[[R14K15]1-17])
SEQ ID NO:50 Protein sequence of CPNv (also known as N[[R14K15]1-17])
SEQ ID NO:51 DNA sequence of the nociceptin-spacer-LC/A-$H_N$/A fusion
SEQ ID NO:52 Protein sequence of the nociceptin-spacer-LC/A-$H_N$/A fusion
SEQ ID NO:53 DNA sequence of the CPN-A GS10 linker
SEQ ID NO:54 DNA sequence of the CPN-A GS15 linker
SEQ ID NO:55 DNA sequence of the CPN-A GS25 linker
SEQ ID NO:56 DNA sequence of the CPN-A GS30 linker
SEQ ID NO:57 DNA sequence of the CPN-A HX27 linker
SEQ ID NO:58 DNA sequence of the LC/A-CPN(GS15)-$H_N$/A fusion
SEQ ID NO:59 Protein sequence of the LC/A-CPN(GS15)-$H_N$/A fusion
SEQ ID NO:60 DNA sequence of the LC/A-CPN(GS25)-$H_N$/A fusion
SEQ ID NO:61 Protein sequence of the LC/A-CPN(GS25)-$H_N$/A fusion
SEQ ID NO:62 DNA sequence of the CPNvar-A Enterokinase activatable linker
SEQ ID NO:63 DNA sequence of the LC/A-CPNv(Ek)-$H_N$/A fusion
SEQ ID NO:64 Protein sequence of the LC/A-CPNv(Ek)-$H_N$/A fusion
SEQ ID NO:65 DNA sequence of the CPNvar-A linker
SEQ ID NO:66 DNA sequence of the LC/C-CPNv-$H_N$/C fusion (act. A)
SEQ ID NO:67 Protein sequence of the LC/C-CPNv-$H_N$/C fusion (act. A)
SEQ ID NO:68 DNA sequence of the LC/A-CPLE-$H_N$/A fusion
SEQ ID NO:69 Protein sequence of the LC/A-CPLE-$H_N$/A fusion
SEQ ID NO:70 DNA sequence of the LC/A-CPOP-$H_N$/A fusion
SEQ ID NO:71 Protein sequence of the LC/A-CPOP-$H_N$/A fusion
SEQ ID NO:72 DNA sequence of the LC/A-CPOPv-$H_N$/A fusion
SEQ ID NO:73 Protein sequence of the LC/A-CPOPv-$H_N$/A fusion
SEQ ID NO:74 DNA sequence of the IgA protease
SEQ ID NO:75 DNA sequence of the IgA-CPNv-$H_N$/A fusion
SEQ ID NO:76 Protein sequence of the IgA-CPNv-$H_N$/A fusion
SEQ ID NO:77 DNA sequence of the FXa-HT
SEQ ID NO:78 DNA sequence of the CPNv-A-FXa-HT
SEQ ID NO:79 Protein sequence of the CPNv-A-FXa-HT fusion
SEQ ID NO:80 DNA sequence of the DT translocation domain
SEQ ID NO:81 DNA sequence of the CPLE-DT-A
SEQ ID NO:82 Protein sequence of the CPLE-DT-A fusion
SEQ ID NO:83 DNA sequence of the TeNT LC
SEQ ID NO:84 DNA sequence of the CPNv-TENT LC
SEQ ID NO:85 Protein sequence of the CPNV-TeNT LC fusion
SEQ ID NO:86 DNA sequence of the CPNvar-C linker
SEQ ID NO:87 DNA sequence of the LC/C-CPNv-$H_N$/C fusion (act. C)
SEQ ID NO:88 Protein sequence of the LC/C-CPNv-$H_N$/C fusion (act. C)
SEQ ID NO:89 Protein sequence of dynorphin
SEQ ID NO:90 DNA sequence of LC/A-CPDY-$H_N$/A fusion
SEQ ID NO:91 Protein sequence of LC/A-CPDY-$H_N$/A fusion
SEQ ID NO:92 Protein sequence of LC/A-CPDY(GS10)-$H_N$/A fusion
SEQ ID NO:93 Protein sequence of LC/A-CPDY(GS15)-$H_N$/A fusion
SEQ ID NO:94 Protein sequence of LC/A-CPDY(GS25)-$H_N$/A fusion
SEQ ID NO:95 Protein sequence of LC/C-CPDY-$H_N$/C fusion
SEQ ID NO:96 Protein sequence of IgA-CPDY-$H_N$/A fusion
SEQ ID NO:97 Protein sequence of CPDY-TeNT LC fusion
SEQ ID NO:98 Protein sequence of LC/A-CPDY-$H_N$/A (GS30) fusion
SEQ ID NO:99 Protein sequence of LC/A-CPDY-$H_N$/A (HX27) fusion
SEQ ID NO:100 Protein sequence of LC/B-CPDY-$H_N$/B fusion
SEQ ID NO:101 Protein sequence of LC/A-CPDY1-13-$H_N$/A fusion
SEQ ID NO:102 Protein sequence of LC/A-CPDY (D15A)-$H_N$/A fusion
SEQ ID NO:103 Protein sequence of LC/A-CPDY (D15A)-$H_N$/A (GS30) fusion
SEQ ID NO:104 Protein sequence of LC/A-CPDY1-13-$H_N$/A (GS30) fusion
SEQ ID NO:105 Protein sequence of LC/A-CPDY (18RP10RD15A)-$H_N$/A fusion SEQ ID NO:106 Protein sequence of LC/A-CPDY (18RP10R)1-13-H$_N$/A fusion
SEQ ID NO:107 Protein sequence of LC/A-CPDNv9-H$_N$/A fusion
SEQ ID NO:108 Protein sequence of BAM1-22
SEQ ID NO:109 Protein sequence of BAMS-22
SEQ ID NO:110 DNA sequence of LC/A-CPBAM(1-22)-H$_N$/A fusion
SEQ ID NO:111 Protein sequence of LC/A-CPBAM(1-22)-H$_N$/A fusion
SEQ ID NO:112 Protein sequence of LC/A-H$_N$/A-BAM (8-22)-H$_N$/A fusion
SEQ ID NO:113 Protein sequence of LC/A-CPBAM(8-22)-H$_N$/A fusion
SEQ ID NO:114 Protein sequence of β-endorphin
SEQ ID NO:115 Protein sequence of LC/D-CPBE-H$_N$/D fusion
SEQ ID NO:116 Protein sequence of LC/B-CPBE-H$_N$/B fusion
SEQ ID NO:117 Protein sequence of bradykinin
SEQ ID NO:118 Protein sequence of des Arg$^9$-BK
SEQ ID NO:119 DNA sequence of LC/A-H$_N$/A-BK fusion
SEQ ID NO:120 Protein sequence of LC/A-H$_N$/A-BK fusion
SEQ ID NO:121 Protein sequence of LC/A-H$_N$/A-des Arg$^9$-BK fusion
SEQ ID NO:122 Protein sequence of Substance P
SEQ ID NO:123 Protein sequence of Substance P analogue (S60)
SEQ ID NO:124 Protein sequence of LC/A-HN/A-S6 fusion
SEQ ID NO:125 Protein sequence of LC/B-CPNv-H$_N$/B fusion
SEQ ID NO:126 Protein sequence of LC/D-CPNv-H$_N$D fusion[
SEQ ID NO:127 DNA sequence of LC/D
SEQ ID NO:128 DNA sequence of H$_N$/D
SEQ ID NO:129 Protein sequence of LHA-EN-CPDNv9
SEQ ID NO:130 Protein sequence of LHA-CPOPv
SEQ ID NO:131 Protein sequence of LHA-EN-CPNv
SEQ ID NO:132 Protein sequence of LHA-Xa-GS-BA-ss
SEQ ID NO:133 Protein sequence of LHA-EK-CPBAM8-22-GS20-HnA-HT
SEQ ID NO:134 Protein sequence of LHA-EK-CPBAM1-22-GS20-HnA-HT
SEQ ID NO:135 Protein sequence of LHA-Xa-CPBE-HT
SEQ ID NO:136 Protein sequence of LHA-Xa-CPBE-HT
SEQ ID NO:137 Protein sequence of LHB-Xa-CPBE-HT
SEQ ID NO:138 Protein sequence of LHD-Xa-CPBE-HT
SEQ ID NO:139 Protein sequence of LHA-BK
SEQ ID NO:140 Protein sequence of LHA-EN-CPDY-HT
SEQ ID NO:141 Protein sequence of LHA-EN-CPDY1-13-GS20-HT
SEQ ID NO:142 Protein sequence of LHA-EN-CPDY-GS30-HT
SEQ ID NO:143 Protein sequence of LHA-EN-CPDY13-GS30-HT
SEQ ID NO:144 Protein sequence of LHA-EN-CPDY (D15A)-GS20-HT
SEQ ID NO:145 Protein sequence of LHA-EN-CPDY (D15A)-GS30-HT
SEQ ID NO:146 Protein sequence of LHB-EN-CPDY-HT
SEQ ID NO:147 Protein sequence of LHA-EN-CPDYI8RP10RD15A-GS20-HT
SEQ ID NO:148 Protein sequence of LHA-EN-CPDY (18RP10R)1-13-GS20-HT
SEQ ID NO:149 Protein sequence of LHA-EN-CPDY-HX27-HT
SEQ ID NO:150 Protein sequence of LHA-EN-CPDNv9-HT
SEQ ID NO:151 Protein sequence of LHA-Xa-CPNv-HT
SEQ ID NO:152 Protein sequence of LHC-Xa-CPNv-HT
SEQ ID NO:153 Protein sequence of LHD-EN-CPNv-HT
SEQ ID NO:154 Protein sequence of LHA-Xa-CPN-HT
SEQ ID NO:155 Protein sequence of LHB-EN-CPNv-HT
SEQ ID NO:156 Protein sequence of LHA-CPOPv-HT
SEQ ID NO:157 Protein sequence of LHA-Xa-GS-S6-ss

EXAMPLES

Example 1

Preparation of a LC/A and H$_N$/A Backbone Clones

The following procedure creates the LC and H$_N$ fragments for use as the component backbone for multidomain fusion expression. This example is based on preparation of a serotype A based clone (SEQ ID NO:1 and SEQ ID NO:2), though the procedures and methods are equally applicable to the other serotypes (illustrated by the sequence listing for serotype B (SEQ ID NO:3 and SEQ ID NO:4) and serotype C (SEQ ID NO:5 and SEQ ID NO:6)).

Preparation of Cloning and Expression Vectors pCR 4 (Invitrogen) is the chosen standard cloning vector, selected due to the lack of restriction sequences within the vector and adjacent sequencing primer sites for easy construct confirmation. The expression vector is based on the pMAL (NEB) expression vector, which has the desired restriction sequences within the multiple cloning site in the correct orientation for construct insertion (BamHI-SalI-PstI-HindIII). A fragment of the expression vector has been removed to create a non-mobilisable plasmid and a variety of different fusion tags have been inserted to increase purification options.

Preparation of Protease (e.g., LC/A) Insert

The LC/A (SEQ ID NO:1) is created by one of two ways:

The DNA sequence is designed by back translation of the LC/A amino acid sequence (obtained from freely available database sources such as GenBank (accession number P10845) or Swissprot (accession locus BXA1_CLOBO) using one of a variety of reverse translation software tools (for example EditSeq best *E. coli* reverse translation (DNASTAR Inc.), or Backtranslation tool v2.0 (Entelechon)). BamHI/SalI recognition sequences are incorporated at the 5' and 3' ends respectively of the sequence, maintaining the correct reading frame. The DNA sequence is screened (using software such as MapDraw, DNASTAR Inc.) for restriction enzyme cleavage sequences incorporated during the back translation. Any cleavage sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence containing the LC/A open reading frame (ORF) is then commercially synthesized (for example by Entelechon, Geneart or Sigma-Genosys) and is provided in the pCR 4 vector.

The alternative method is to use PCR amplification from an existing DNA sequence with BamHI and SalI restriction enzyme sequences incorporated into the 5' and 3' PCR primers respectively. Complementary oligonucleotide primers are chemically synthesised by a supplier (for example MWG or Sigma-Genosys), so that each pair has the ability to hybridize to the opposite strands (3' ends pointing "towards" each other) flanking the stretch of *Clostridium* target DNA, one oligonucleotide for each of the two DNA strands. To generate a PCR product the pair of short oligonucleotide primers specific for the *Clostridium* DNA sequence are mixed with the *Clostridium* DNA template and other reaction components and placed in a machine (the 'PCR machine') that can change the incubation temperature of the reaction tube automatically, cycling between approximately 94° C. (for denaturation), 55° C. (for oligonucleotide annealing), and 72° C. (for synthesis). Other reagents required for amplification of a PCR product include a DNA polymerase (such as Taq or Pfu polymerase), each of the four nucleotide dNTP building blocks of DNA in equimolar amounts (50-200 μM) and a buffer appropriate for the enzyme optimised for $Mg^{2+}$ concentration (0.5-5 mM).

The amplification product is cloned into pCR 4 using either, TOPO TA cloning for Taq PCR products or Zero Blunt TOPO cloning for Pfu PCR products (both kits commercially available from Invitrogen). The resultant clone is checked by sequencing. Any additional restriction sequences which are not compatible with the cloning system are then removed using site directed mutagenesis (for example, using Quick-change (Stratagene Inc.)).

Preparation of Translocation (e.g., $H_N$) Insert

The $H_N$/A (SEQ ID NO:2) is created by one of two ways:

The DNA sequence is designed by back translation of the $H_N$/A amino acid sequence (obtained from freely available database sources such as GenBank (accession number P10845) or Swissprot (accession locus BXA1_CLOBO)) using one of a variety of reverse translation software tools (for example EditSeq best *E. coli* reverse translation (DNASTAR Inc.), or Backtranslation tool v2.0 (Entelechon)). A PstI restriction sequence added to the N-terminus and XbaI-stop codon-HindIII to the C-terminus ensuring the correct reading frame is maintained. The DNA sequence is screened (using software such as MapDraw, DNASTAR Inc.) for restriction enzyme cleavage sequences incorporated during the back translation. Any sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesised (for example by Entelechon, Geneart or Sigma-Genosys) and is provided in the pCR 4 vector.

The alternative method is to use PCR amplification from an existing DNA sequence with PstI and XbaI-stop codon-HindIII restriction enzyme sequences incorporated into the 5' and 3' PCR primers respectively. The PCR amplification is performed as described above. The PCR product is inserted into pCR 4 vector and checked by sequencing. Any additional restriction sequences which are not compatible with the cloning system are then removed using site directed mutagenesis [for example using Quickchange (Stratagene Inc.)].

Example 2

Preparation of a LC/A-nociceptin-$H_N$/A Fusion Protein (Nociceptin is N-Terminal of the $H_N$-Chain)

Preparation of Linker-Nociceptin-Spacer Insert

The LC-$H_N$ linker can be designed from first principle, using the existing sequence information for the linker as the template. For example, the serotype A linker (in this case defined as the inter-domain polypeptide region that exists between the cysteines of the disulphide bridge between LC and $H_N$) is 23 amino acids long and has the sequence VRGI-ITSKTKSLDKGYNKALNDL (SEQ ID NO:164). Within this sequence, it is understood that proteolytic activation in nature leads to an $H_N$ domain that has an N-terminus of the sequence ALNDL (SEQ ID NO:165). This sequence information is freely available from available database sources such as GenBank (accession number P10845) or Swissprot (accession locus BXA1_CLOBO). Into this linker a Factor Xa site, nociceptin and spacer are incorporated; and using one of a variety of reverse translation software tools [for example, EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-SalI-linker-protease site-nociceptin-NheI-spacer-SpeI-PstI-XbaI-stop codon-HindIII (SEQ ID NO:7). It is important to ensure the correct reading frame is maintained for the spacer, nociceptin and restriction sequences and that the XbaI sequence is not preceded by the bases, TC, which would result on DAM methylation. The DNA sequence is screened for restriction sequence incorporation, and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example, GenBank Release 143, 13 Sep. 2004). This optimised DNA sequence is then commercially synthesized (for example by Entelechon, Geneart or Sigma-Genosys) and is provided in the pCR 4 vector.

Preparation of the LC/A-nociceptin-$H_N$/A Fusion

In order to create the LC-linker-nociceptin-spacer-$H_N$ construct (SEQ ID NO:13), the pCR 4 vector encoding the linker (SEQ ID NO:7) is cleaved with BamHI+SalI restriction enzymes. This cleaved vector then serves as the recipient vector for insertion and ligation of the LC/A DNA (SEQ ID NO:1) cleaved with BamHI+SalI. The resulting plasmid DNA is then cleaved with PstI+XbaI restriction enzymes and serves as the recipient vector for the insertion and ligation of the $H_N$/A DNA (SEQ ID NO:2) cleaved with PstI+XbaI. The final construct contains the LC-linker-nociceptin-spacer-$H_N$ ORF (SEQ ID NO:13) for transfer into expression vectors for expression to result in a fusion protein of the sequence illustrated in SEQ ID NO:14.

Example 3

Preparation of a nociceptin-LC/A-$H_N$/A Fusion Protein (Nociceptin is N-Terminal of the LC-Chain)

The LC/A-$H_N$/A backbone is constructed as described in Example 2 using the synthesised A serotype linker with the addition of a Factor Xa site for activation, arranged as BamHI-SalI-linker-protease site-linker-PstI-XbaI-stop codon-HindIII (SEQ ID NO:8). The LC/A-$H_N$/A backbone and the synthesised N-terminal presentation nociceptin insert (SEQ ID NO:9) are cleaved with BamHI+HindIII restriction enzymes, gel purified and ligated together to create a nociceptin-spacer-LC-linker-$H_N$. The ORF (SEQ ID NO:15) is then cut out using restriction enzymes AvaI+XbaI for transfer into expression vectors for expression to result in a fusion protein of the sequence illustrated in SEQ ID NO:16.

Example 4

Preparation of a LC/C-nociceptin-$H_N$/C Fusion Protein

Following the methods used in Examples 1 and 2, the LC/C (SEQ ID NO:5) and $H_N$/C (SEQ ID NO:6) are created and inserted into the C serotype linker arranged as BamHI-SalI-linker-protease site-nociceptin-NheI-spacer-SpeI-PstI-XbaI-stop codon-HindIII (SEQ ID NO:10). The final construct contains the LC-linker-nociceptin-spacer-$H_N$ ORF (SEQ ID NO:17) for expression as a protein of the sequence illustrated in SEQ ID NO:18.

Example 5

Preparation of a LC/C-nociceptin-$H_N$/C Fusion Protein with a Serotype A Activation Sequence Following the methods used in Examples 1 and 2, the LC/C (SEQ ID NO:5) and $H_N$/C (SEQ ID NO:6) are created and inserted into the A serotype linker arranged as BamHI-SalI-linker-protease site-nociceptin-NheI-spacer-SpeI-PstI-XbaI-stop codon-HindIII (SEQ ID NO:7). The final construct contains the LC-linker-nociceptin-spacer-$H_N$ ORF (SEQ ID NO:19) for expression as a protein of the sequence illustrated in SEQ ID NO:20.

Example 6

Preparation of a LC/A-MET enkephalin-$H_N$/A Fusion Protein

Due to the small, five-amino acid, size of the met-enkephalin ligand the LC/A-met enkephalin-$H_N$/A fusion is created by site directed mutagenesis (for example using Quickchange (Stratagene Inc.)) using the LC/A-nociceptin-$H_N$/A fusion (SEQ ID NO:13) as a template. Oligonucleotides are designed encoding the YGGFM met-enkephalin peptide, ensuring standard E. coli codon usage is maintained and no additional restriction sites are incorporated, flanked by sequences complimentary to the linker region of the LC/A-nociceptin-$H_N$/A fusion (SEQ ID NO:13) either side on the nociceptin section. The SDM product is checked by sequencing and the final construct containing the LC-linker-met enkephalin-spacer-$H_N$ ORF (SEQ ID NO:21) for expression as a protein of the sequence illustrated in SEQ ID NO:22.

Example 7

Preparation of a LC/A-B endorphin-$H_N$/A Fusion Protein

Following the methods used in Examples 1 and 2, the LC/A (SEQ ID NO:1) and $H_N$/A (SEQ ID NO:2) are created and inserted into the A serotype β endorphin linker arranged as BamHI-SalI-linker-protease site-β endorphin-NheI-spacer-SpeI-PstI-XbaI-stop codon-HindIII (SEQ ID NO:11). The final construct contains the LC-linker-13 endorphin-spacer-$H_N$ ORF (SEQ ID NO:23) for expression as a protein of the sequence illustrated in SEQ ID NO:24.

Example 8

Preparation of a LC/A-nociceptin Variant-$H_N$/A Fusion Protein

Following the methods used in Examples 1 and 2, the LC/A (SEQ ID NO:1) and $H_N$/A (SEQ ID NO:2) are created and inserted into the A serotype nociceptin variant linker arranged as BamHI-SalI-linker-protease site-nociceptin variant-NheI-spacer-SpeI-PstI-XbaI-stop codon-HindIII (SEQ ID NO:12). The final construct contains the LC-linker-nociceptin variant-spacer-$H_N$ ORF (SEQ ID NO:25) for expression as a protein of the sequence illustrated in SEQ ID NO:26.

Example 9

Purification Method for LC/A-nociceptin-$H_N$/A Fusion Protein

Defrost falcon tube containing 25 ml 50 mM HEPES pH 7.2, 200 mM NaCl and approximately 10 g of E. coli BL21 cell paste. Make the thawed cell paste up to 80 ml with 50 mM HEPES pH 7.2, 200 mM NaCl and sonicate on ice 30 seconds on, 30 seconds off for 10 cycles at a power of 22 microns ensuring the sample remains cool. Spin the lysed cells at 18 000 rpm, 4° C. for 30 minutes. Load the supernatant onto a 0.1 M $NiSO_4$ charged Chelating column (20-30 ml column is sufficient) equilibrated with 50 mM HEPES pH 7.2, 200 mM NaCl. Using a step gradient of 10 and 40 mM imidazol, wash away the non-specific bound protein and elute the fusion protein with 100 mM imidazol. Dialyse the eluted fusion protein against 5 L of 50 mM HEPES pH 7.2, 200 mM NaCl at 4° C. overnight and measure the OD of the dialysed fusion protein. Add 1 unit of factor Xa per 100 μg fusion protein and Incubate at 25° C. static overnight. Load onto a 0.1 M $NiSO_4$ charged Chelating column (20-30 ml column is sufficient) equilibrated with 50 mM HEPES pH 7.2, 200 mM NaCl. Wash column to baseline with 50 mM HEPES pH 7.2, 200 mM NaCl. Using a step gradient of 10 and 40 mM imidazol, wash away the non-specific bound protein and elute the fusion protein with 100 mM imidazol. Dialyse the eluted fusion protein against 5 L of 50 mM HEPES pH 7.2, 200 mM NaCl at 4° C. overnight and concentrate the fusion to about 2 mg/ml, aliquot sample and freeze at −20° C. Test purified protein using OD, BCA, purity analysis and SNAP-25 assessments.

Example 10

Confirmation of TM Agonist Activity by Measuring Release of Substance P From Neuronal Cell Cultures Materials Substance P EIA is obtained from R&D Systems, UK.

Methods

Primary neuronal cultures of eDRG are established as described previously (Duggan et al., 2002, J. Biol. Chem., 277:34846-34852). Substance P release from the cultures is assessed by EIA, essentially as described previously (Duggan et al., 2002, J. Biol. Chem., 277:34846-34852). The TM of interest is added to the neuronal cultures (established for at least 2 weeks prior to treatment); control cultures are performed in parallel by addition of vehicle in place of TM. Stimulated (100 mM KCl) and basal release, together with total cell lysate content, of substance P are obtained for both control and TM treated cultures. Substance P immunoreactivity is measured using Substance P Enzyme Immunoassay Kits (Cayman Chemical Company, USA or R&D Systems, UK) according to manufacturers' instructions.

The amount of Substance P released by the neuronal cells in the presence of the TM of interest is compared to the release obtained in the presence and absence of 100 mM KCl. Stimulation of Substance P release by the TM of interest above the basal release, establishes that the TM of interest is an "agonist ligand" as defined in this specification. If desired the stimulation of Substance P release by the TM of interest can be compared to a standard Substance P release-curve produced using the natural $ORL_1$ receptor ligand, nociceptin (Tocris).

Example 11

Confirmation of $ORL_1$ Receptor Activation by Measuring Forskolin-Stimulated Camp Production Confirmation that a given TM is acting via the $ORL_1$ receptor is provided by the following test, in which the TMs ability to inhibit forskolin-stimulated cAMP production is assessed.

Materials

[$^3$H]adenine and [$^{14}$C]cAMP are obtained from GE Healthcare

Methods

The test is conducted essentially as described previously by Meunier et al. (Isolation and structure of the endogenous agonist of opioid receptor-like ORL$_1$ receptor. *Nature* 377: 532-535, 1995) in intact transfected-CHO cells plated on 24-well plastic plates.

To the cells is added [$^3$H]adenine (1.0 μCi) in 0.4 ml of culture medium. The cells remain at 37° C. for 2 h to allow the adenine to incorporate into the intracellular ATP pool. After 2 h, the cells are washed once with incubation buffer containing: 130 mM NaCl, 4.8 mM KCl, 1.2 mM KH$_2$PO$_4$, 1.3 mM CaCl$_2$, 1.2 mM MgSO$_4$, 10 mM glucose, 1 mg/ml bovine serum albumin and 25 mM HEPES pH 7.4, and replaced with buffer containing forskolin (10 μM) and isobutylmethylxanthine (50 μM) with or without the TM of interest. After 10 min, the medium is aspirated and replaced with 0.5 ml, 0.2 M HCl. Approximately 1000 cpm of [$^{14}$C]cAMP is added to each well and used as an internal standard. The contents of the wells are then transferred to columns of 0.65 g dry alumina powder. The columns are eluted with 4 ml of 5 mM HCl, 0.5 ml of 0.1 M ammonium acetate, then two additional milliliters of ammonium acetate. The final eluate is collected into scintillation vials and counted for $^{14}$C and tritium. Amounts collected are corrected for recovery of [$^{14}$C]cAMP. TMs that are agonists at the ORL$_1$ receptor cause a reduction in the level of cAMP produced in response to forskolin.

Example 12

Confirmation of ORL$_1$ Receptor Activation Using a GTPγS Binding Functional Assay Confirmation that a given TM is acting via the ORL$_1$ receptor is also provided by the following test, a GTPγS binding functional assay.
Materials
[$^{35}$S]GTPγS is obtained from GE Healthcare
Wheatgerm agglutinin-coated (SPA) beads are obtained from GE Healthcare
Methods
This assay is carried out essentially as described by Traynor and Nahorski (Modulation by μ-opioid agonists of guanosine-5-O-[$^{35}$S]thio)triphosphate binding to membranes from human neuroblastoma SH-SY5Y cells. *Mol. Pharmacol.* 47: 848-854, 1995).

Cells are scraped from tissue culture dishes into 20 mM HEPES, 1 mM ethylenediaminetetraacetic acid, then centrifuged at 500×g for 10 min. Cells are resuspended in this buffer and homogenized with a Polytron Homogenizer.

The homogenate is centrifuged at 27,000×g for 15 min, and the pellet resuspended in buffer A, containing: 20 mM HEPES, 10 mM MgCl$_2$, 100 mM NaCl, pH 7.4. The suspension is recentrifuged at 20,000×g and suspended once more in buffer A. For the binding assay, membranes (8-15 μg protein) are incubated with [$^{35}$S]GTP S (50 pM), GDP (10 μM), with and without the TM of interest, in a total volume of 1.0 ml, for 60 min at 25° C. Samples are filtered over glass fibre filters and counted as described for the binding assays.

Example 13

Preparation of a LC/A-nociceptin-H$_N$/A Fusion Protein (Nociceptin is N-Terminal of the H$_N$-Chain)

The linker-nociceptin-spacer insert is prepared as described in Example 2.
Preparation of the LC/A-nociceptin-H$_N$/A Fusion In order to create the LC-linker-nociceptin-spacer-H$_N$ construct (SEQ ID NO:13), the pCR 4 vector encoding the linker (SEQ ID NO:7) is cleaved with BamHI+SalI restriction enzymes. This cleaved vector then serves as the recipient for insertion and ligation of the LC/A DNA (SEQ ID NO:1) also cleaved with BamHI+SalI. The resulting plasmid DNA is then cleaved with BamHI+HindIII restriction enzymes and the LC/A-linker fragment inserted into a similarly cleaved vector containing a unique multiple cloning site for BamHI, SalI, PstI, and HindIII such as the pMAL vector (NEB). The H$_N$/A DNA (SEQ ID NO:2) is then cleaved with PstI+HindIII restriction enzymes and inserted into the similarly cleaved pMAL-LC/A-linker construct. The final construct contains the LC-linker-nociceptin-spacer-H$_N$ ORF (SEQ ID NO:13) for expression as a protein of the sequence illustrated in SEQ ID NO:14.

Example 14

Preparation of a Nociceptin-LC/A-H$_N$/A Fusion Protein (Nociceptin is N-Terminal of the LC-Chain)

In order to create the nociceptin-spacer-LC/A-H$_N$/A construct, an A serotype linker with the addition of a Factor Xa site for activation, arranged as BamHI-SalI-linker-protease site-linker-PstI-XbaI-stop codon-HindIII (SEQ ID NO:8) is synthesised as described in Example 13. The pCR 4 vector encoding the linker is cleaved with BamHI+SalI restriction enzymes. This cleaved vector then serves as the recipient for insertion and ligation of the LC/A DNA (SEQ ID NO:1) also cleaved with BamHI+SalI. The resulting plasmid DNA is then cleaved with BamHI+HindIII restriction enzymes and the LC/A-linker fragment inserted into a similarly cleaved vector containing the synthesised N-terminal presentation nociceptin insert (SEQ ID NO:9). This construct is then cleaved with AvaI+HindIII and inserted into an expression vector such as the pMAL plasmid (NEB). The H$_N$/A DNA (SEQ ID NO:2) is then cleaved with PstI+HindIII restriction enzymes and inserted into the similarly cleaved pMAL-nociceptin-LC/A-linker construct. The final construct contains the nociceptin-spacer-LC/A-H$_N$/A ORF (SEQ ID NO:51) for expression as a protein of the sequence illustrated in SEQ ID NO:52.

Example 15

Preparation and Purification of an LC/A-nociceptin-H$_N$/A Fusion Protein Family with Variable Spacer Length Using the same strategy as employed in Example 2, a range of DNA linkers were prepared that encoded nociceptin and variable spacer content. Using one of a variety of reverse translation software tools (for example EditSeq best *E. coli* reverse translation (DNASTAR Inc.), or Backtranslation tool v2.0 (Entelechon)), the DNA sequence encoding the linker-ligand-spacer region is determined. Restriction sites are then incorporated into the DNA sequence and can be arranged as BamHI-SalI-linker-protease site-nociceptin-NheI-spacer-SpeI-PstI-XbaI-stop codon-HindIII (SEQ ID NO:53 to SEQ ID NO:57). It is important to ensure the correct reading frame is maintained for the spacer, nociceptin and restriction sequences and that the XbaI sequence is not preceded by the bases, TC which would result on DAM methylation. The DNA sequence is screened for restriction sequence incorporation and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesized (for example by Entelechon, Geneart or Sigma-Genosys) and is provided in the pCR 4 vector.

The spacers that were created included:

TABLE 1

| Code | Protein sequence of the linker | SEQ ID NO of the linker DNA |
|---|---|---|
| GS10 | ALAGGGGSALVLQ | 53 |
| GS15 | ALAGGGGSGGGGSALVLQ | 54 |
| GS25 | ALAGGGGSGGGGSGGGGSGGGGSALVLQ | 55 |
| GS30 | ALAGGGGSGGGGSGGGGSGGGGSGGGGSALVLQ | 56 |
| Hx27 | ALAAEAAAKEAAAKEAAAKAGGGGSALVLQ | 57 |

By way of example, in order to create the LC/A-CPN (GS15)-$H_N$/A fusion construct (SEQ ID NO:58), the pCR 4 vector encoding the linker (SEQ ID NO:54) is cleaved with BamHI+SalI restriction enzymes. This cleaved vector then serves as the recipient vector for insertion and ligation of the LC/A DNA (SEQ ID NO:1) also cleaved with BamHI+SalI. The resulting plasmid DNA is then cleaved with BamHI+HindIII restriction enzymes and the LC/A-linker fragment inserted into a similarly cleaved vector containing a unique multiple cloning site for BamHI, SalI, PstI, and HindIII such as the pMAL vector (NEB). The $H_N$/A DNA (SEQ ID NO:2) is then cleaved with PstI+HindIII restriction enzymes and inserted into the similarly cleaved pMAL-LC/A-linker construct. The final construct contains the LC/A-CPN(GS15)-$H_N$/A ORF (SEQ ID NO:58) for expression as a protein of the sequence illustrated in SEQ ID NO:59.

As a further example, to create the LC/A-CPN(GS25)-$H_N$/A fusion construct (SEQ ID NO:60), the pCR 4 vector encoding the linker (SEQ ID NO:55) is cleaved with BamHI+SalI restriction enzymes. This cleaved vector then serves as the recipient vector for insertion and ligation of the LC/A DNA (SEQ ID NO:1) cleaved with BamHI+SalI. The resulting plasmid DNA is then cleaved with BamHI+HindIII restriction enzymes and the LC/A-linker fragment inserted into a similarly cleaved vector containing a unique multiple cloning site for BamHI, SalI, PstI, and HindIII such as the pMAL vector (NEB). The $H_N$/A DNA (SEQ ID NO:2) is then cleaved with PstI+HindIII restriction enzymes and inserted into the similarly cleaved pMAL-LC/A-linker construct. The final construct contains the LC/A-CPN(GS25)-$H_N$/A ORF (SEQ ID NO:60) for expression as a protein of the sequence illustrated in SEQ ID NO:61.

Variants of the LC/A-CPN-$H_N$/A fusion consisting of GS10, GS30 and Hx27 are similarly created. Using the purification methodology described in Example 9, fusion protein is purified from *E. coli* cell paste. FIG. 9 illustrates the purified product obtained in the case of LC/A-CPN(GS10)-$H_N$/A, LC/A-CPN(GS15)-$H_N$/A, LC/A-CPN(GS25)-$H_N$/A, LC/A-CPN(GS30)-$H_N$/A and LC/A-CPN(Hx27)-$H_N$/A.

Example 16

Assessment of In Vitro Efficacy of an LC/A-nociceptin-$H_N$/A Fusion

Fusion protein prepared according to Examples 2 and 9 was assessed in the eDRG neuronal cell model.

Assays for the inhibition of substance P release and cleavage of SNAP-25 have been previously reported (Duggan et al., 2002, *J. Biol. Chem.*, 277:34846-34852). Briefly, dorsal root ganglia neurons are harvested from 15-day-old fetal Sprague-Dawley rats and dissociated cells plated onto 24-well plates coated with Matrigel at a density of $1\times10^6$ cells/well. One day post-plating the cells are treated with 1 μM cytosine β-D-arabinofuranoside for 48 h. Cells are maintained in Dulbecco's minimal essential medium supplemented with 5% heat-inactivated fetal bovine serum, 5 mM L-glutamine, 0.6% D-glucose, 2% B27 supplement, and 100 ng/ml 2.5S mouse nerve growth factor. Cultures are maintained for 2 weeks at 37° C. in 95% air/5% $CO_2$ before addition of test materials.

Release of substance P from eDRG is assessed by enzyme-linked immunosorbent assay. Briefly, eDRG cells are washed twice with low potassium-balanced salt solution (BSS: 5 mM KCl, 137 mM NaCl, 1.2 mM $MgCl_2$, 5 mM glucose, 0.44 mM $KH_2PO_4$, 20 mM HEPES, pH 7.4, 2 mM $CaCl_2$). Basal samples are obtained by incubating each well for 5 min. with 1 ml of low potassium BSS. After removal of this buffer, the cells are stimulated to release by incubation with 1 ml of high potassium buffer (BSS as above with modification to include 100 mM KCl isotonically balanced with NaCl) for 5 min. All samples are removed to tubes on ice prior to assay of substance P. Total cell lysates are prepared by addition of 250 μl of 2 M acetic acid/0.1% trifluoroacetic acid to lyse the cells, centrifugal evaporation, and resuspension in 500 μl of assay buffer. Diluted samples are assessed for substance P content. Substance P immunoreactivity is measured using Substance P Enzyme Immunoassay Kits (Cayman Chemical Company or R&D Systems) according to manufacturers' instructions. Substance P is expressed in pg/ml relative to a standard substance P curve run in parallel.

SDS-PAGE and Western blot analysis were performed using standard protocols (Novex). SNAP-25 proteins were resolved on a 12% Tris/glycine polyacrylamide gel (Novex) and subsequently transferred to nitrocellulose membrane. The membranes were probed with a monoclonal antibody (SMI-81) that recognises cleaved and intact SNAP-25. Specific binding was visualised using peroxidase-conjugated secondary antibodies and a chemiluminescent detection system. Cleavage of SNAP-25 was quantified by scanning densitometry (Molecular Dynamics Personal SI, ImageQuant data analysis software). Percent SNAP-25 cleavage was calculated according to the formula: (Cleaved SNAP-25/(Cleaved+Intact SNAP-25))×100.

Following exposure of eDRG neurons to an LC/A-nociceptin-$H_N$/A fusion (termed CPN-A), both inhibition of substance P release and cleavage of SNAP-25 are observed (FIG. 10). After 24 h exposure to the fusion, 50% of maximal SNAP-25 cleavage is achieved by a fusion concentration of 6.3±2.5 nM.

The effect of the fusion is also assessed at defined time points following a 16 h exposure of eDRG to CPN-A. FIG. 11 illustrates the prolonged duration of action of the CPN-A fusion protein, with measurable activity still being observed at 28 days post exposure.

Example 17

Assessment of In Vitro Efficacy of an LC/A-nociceptin Variant-$H_N$/A Fusion Fusion protein prepared according to Examples 8 and 9 was assessed in the eDRG neuronal cell mode using the method described in Example 16.

Following exposure of eDRG neurons to an LC/A-nociceptin variant-$H_N$/A fusion (termed CPNv-A), both inhibition of substance P release and cleavage of SNAP-25 are observed. After 24 h exposure to the fusion, 50% of maximal SNAP-25 cleavage is achieved by a fusion concentration of 1.4±0.4 nM (FIG. 12).

The effect of the fusion is also assessed at defined time points following a 16 h exposure of eDRG to CPN-A. FIG. 13 illustrates the prolonged duration of action of the CPN-A fusion protein, with measurable activity still being observed at 24 days post exposure.

The binding capability of the CPNv-A fusion protein is also assessed in comparison to the CPN-A fusion. FIG. 14 illustrates the results of a competition experiment to determine binding efficacy at the ORL-1 receptor. CPNv-A is demonstrated to displace [$^3$H]-nociceptin, thereby confirming that access to the receptor is possible with the ligand in the central presentation format.

Example 18

Preparation of an LC/A-nociceptin Variant-$H_N$/A Fusion Protein that is Activated by Treatment with Enterokinase Following the methods used in Examples 1 and 2, the LC/A (SEQ ID NO:1) and $H_N$/A (SEQ ID NO:2) are created and inserted into the A serotype nociceptin variant linker arranged as BamHI-SalI-linker-enterokinase protease site-nociceptin variant-NheI-spacer-SpeI-PstI-XbaI-stop codon-HindIII (SEQ ID NO:62). The final construct contains the LC-linker-nociceptin variant-spacer-$H_N$ ORF sequences (SEQ ID NO:63) for expression as a protein of the sequence illustrated in SEQ ID NO:64. The fusion protein is termed CPNv(Ek)-A. FIG. 15 illustrates the purification of CPNv(Ek)-A from *E. coli* following the methods used in Example 9 but using Enterokinase for activation at 0.00064 µg per 100 µg of fusion protein.

Example 19

Assessment of In Vitro Efficacy of a LC/A-nociceptin variant-$H_N$/A Fusion that has been Activated by Treatment with Enterokinase The CPNv(Ek)-A prepared in Example 18 is obtained in a purified form and applied to the eDRG cell model to assess cleavage of SNAP-25 (using methodology from Example 16). FIG. 16 illustrates the cleavage of SNAP-25 following 24 h exposure of eDRG to CPNv(Ek)-A. The efficiency of cleavage is observed to be similar to that achieved with the Factor Xa-cleaved material, as recorded in Example 17.

Example 20

Preparation of an LC/C-nociceptin Variant-$H_N$/C Fusion Protein with a Factor Xa Activation Linker Derived from Serotype A Following the methods used in Example 4, the LC/C (SEQ ID NO:5) and $H_N$/C (SEQ ID NO:6) are created and inserted into the A serotype nociceptin variant linker arranged as BamHI-SalI-linker-nociceptin variant-NheI-spacer-SpeI-PstI-XbaI-stop codon-HindIII (SEQ ID NO:65). The final construct contains the LC-linker-nociceptin variant-spacer-$H_N$ ORF sequences (SEQ ID NO:66) for expression as a protein of the sequence illustrated in SEQ ID NO:67. The fusion protein is termed CPNv-C (act. A). FIG. 17 illustrates the purification of CPNv-C (act. A) from *E. coli* following the methods used in Example 9.

Example 21

Assessment of In Vitro Efficacy of an LC/C-nociceptin Variant-$H_N$/C Fusion Protein Following the methods used in Example 9, the CPNv-C (act. A) prepared in Example 20 is obtained in a purified form and applied to the eDRG cell model to assess cleavage of SNAP-25 (using methodology from Example 16). After 24 h exposure to the fusion, 50% of maximal syntaxin cleavage is achieved by a fusion concentration of 3.1±2.0 nM. FIG. 18 illustrates the cleavage of syntaxin following 24 h exposure of eDRG to CPNv-C (act. A).

Example 22

Assessment of In Vivo Efficacy of an LC/A-nociceptin-HN/A Fusion

The ability of an LC/A-nociceptin-$H_N$/A fusion (CPN/A) to inhibit acute capsaicin-induced mechanical allodynia is evaluated following subcutaneous intraplantar injection in the rat hind paw. Test animals are evaluated for paw withdrawal frequency (PWF %) in response to a 10 g Von Frey filament stimulus series (10 stimuli×3 trials) prior to recruitment into the study, after subcutaneous treatment with CPN/A but before capsaicin, and following capsaicin challenge post-injection of CPN/A (average of responses at 15' and 30'). Capsaicin challenge is achieved by injection of 10 µl of a 0.3% solution. Sample dilutions are prepared in 0.5% BSA/saline. FIG. 19 illustrates the reversal of mechanical allodynia that is achieved by pre-treatment of the animals with a range of concentrations of LC/A-nociceptin-HN/A fusion.

The ability of an LC/A-nociceptin-HN/A fusion (CPN/A) to inhibit streptozotocin (STZ)-induced mechanical (tactile) allodynia in rats is evaluated. STZ-induced mechanical allodynia in rats is achieved by injection of streptozotocin (i.p. or i.v.) which yields destruction of pancreatic β-cells leading to loss of insulin production, with concomitant metabolic stress (hyperglycemia and hyperlipidemia). As such, STZ induces Type I diabetes. In addition, STZ treatment leads to progressive development of neuropathy, which serves as a model of chronic pain with hyperalgesia and allodynia that may reflect signs observed in diabetic humans (peripheral diabetic neuropathy).

Male Sprague-Dawley rats (250-300 g) are treated with 65 mg/kg STZ in citrate buffer (I.V.) and blood glucose and lipid are measured weekly to define the readiness of the model. Paw Withdrawal Threshold (PWT) is measured in response to a Von Frey filament stimulus series over a period of time. Allodynia is said to be established when the PWT on two consecutive test dates (separated by 1 week) measures below 6 g on the scale. At this point, rats are randomized to either a saline group (negative efficacy control), gabapentin group (positive efficacy control) or a test group (CPN/A). Test materials (20-25 µl) are injected subcutaneously as a single injection (except gabapentin) and the PWT is measured at 1 day post-treatment and periodically thereafter over a 2-week period. Gabapentin (30 mg/kg i.p. @ 3 ml/kg injection volume) is injected daily, 2 hours prior to the start of PWT testing. FIG. 20 illustrates the reversal of allodynia achieved by pre-treatment of the animals with 750 ng of CPN/A. Data were obtained over a 2-week period after a single injection of CPN/A

Example 23

Assessment of In Vivo Efficacy of an LC/A-nociceptin Variant-$H_N$/A Fusion

The ability of an LC/A-nociceptin variant-$H_N$/A fusion (CPNv/A) to inhibit capsaicin-induced mechanical allodynia is evaluated following subcutaneous intraplantar injection in the rat hind paw. Test animals are evaluated for paw withdrawal frequency (PWF %) in response to a 10 g Von Frey filament stimulus series (10 stimuli×3 trials) prior to recruitment into the study (Pre-Treat); after subcutaneous intraplantar treatment with CPNv/A but before capsaicin (Pre-CAP); and following capsaicin challenge post-injection of CPNv/A (average of responses at 15' and 30'; CAP). Capsaicin challenge is achieved by injection of 10 µl of a 0.3% solution. Sample dilutions are prepared in 0.5% BSA/saline.

FIG. 21 illustrates the reversal of allodynia that is achieved by pre-treatment of the animals with a range of concentrations of LC/A-nociceptin variant-$H_N$/A fusion in comparison to the reversal achieved with the addition of LC/A-nociceptin-$H_N$/A fusion. These data are expressed as a normalized paw withdrawal frequency differential, in which the difference between the peak response (post-capsaicin) and the baseline response (pre-capsaicin) is expressed as a percentage. With this analysis, it can be seen that CPNv/A is more potent than CPN/A since a lower dose of CPNv/A is required to achieve similar analgesic effect to that seen with CPN/A.

Example 24

Preparation of an LC/A-leu enkephalin-$H_N$/A Fusion Protein

Due to the small, five-amino acid, size of the leu-enkephalin ligand the LC/A-leu enkephalin-$H_N$/A fusion is created by site directed mutagenesis (for example using Quickchange® (Stratagene Inc.)), using the LC/A-nociceptin-$H_N$/A fusion (SEQ ID NO:13) as a template. Oligonucleotides are designed encoding the YGGFL leu-enkephalin peptide, ensuring standard *E. coli* codon usage is maintained and no additional restriction sites are incorporated, flanked by sequences complimentary to the linker region of the LC/A-nociceptin-$H_N$/A fusion (SEQ ID NO:13) either side on the nociceptin section. The SDM product is checked by sequencing and the final construct containing the LC-linker-leu enkephalin-spacer-$H_N$ ORF (SEQ ID NO:68) for expression as a protein of the sequence illustrated in SEQ ID NO:69. The fusion protein is termed CPLE-A. FIG. 22 illustrates the purification of CPLE-A from *E. coli* following the methods used in Example 9.

Example 25

Expression and Purification of an LC/A-beta-endorphin-$H_N$/A Fusion Protein Following the methods used in Example 9, and with the LC/A-beta-endorphin-$H_N$/A fusion protein (termed CPBE-A) created in Example 7, the CPBE-A is purified from *E. coli*. FIG. 23 illustrates the purified protein as analysed by SDS-PAGE.

Example 26

Preparation of an LC/A-nociceptin Mutant-$H_N$/A Fusion Protein

Due to the single amino acid modification necessary to mutate the nociceptin sequence at position 1 from a Phe to a Tyr, the LC/A-nociceptin mutant-$H_N$/A fusion is created by site directed mutagenesis (for example using Quickchange® (Stratagene Inc.)), using the LC/A-nociceptin-$H_N$/A fusion (SEQ ID NO:13) as a template. Oligonucleotides are designed encoding tyrosine at position 1 of the nociceptin sequence, ensuring standard *E. coli* codon usage is maintained and no additional restriction sites are incorporated, flanked by sequences complimentary to the linker region of the LC/A-nociceptin-$H_N$/A fusion (SEQ ID NO:13) either side on the nociceptin section. The SDM product is checked by sequencing and the final construct containing the LC/A-nociceptin mutant-spacer-$H_N$/A fusion ORF (SEQ ID NO:70) for expression as a protein of the sequence illustrated in SEQ ID NO:71. The fusion protein is termed CPOP-A. FIG. 24 illustrates the purification of CPOP-A from *E. coli* following the methods used in Example 9.

Example 27

Preparation and Assessment of an LC/A-nociceptin Variant Mutant-$H_N$/A Fusion Protein Due to the single amino acid modification necessary to mutate the nociceptin sequence at position 1 from a Phe to a Tyr, the LC/A-nociceptin variant mutant-$H_N$/A fusion is created by site directed mutagenesis (for example using Quickchange (Stratagene Inc.)), using the LC/A-nociceptin variant-$H_N$/A fusion (SEQ ID NO:25) as a template. Oligonucleotides are designed encoding tyrosine at position 1 of the nociceptin sequence, ensuring standard *E. coli* codon usage is maintained and no additional restriction sites are incorporated, flanked by sequences complimentary to the linker region of the LC/A-nociceptin variant-$H_N$/A fusion (SEQ ID NO:25) either side on the nociceptin section. The SDM product is checked by sequencing and the final construct containing the LC/A-nociceptin mutant-spacer-$H_N$/A fusion ORF (SEQ ID NO:72) for expression as a protein of the sequence illustrated in SEQ ID NO:73. The fusion protein is termed CPOPv-A. FIG. 25 illustrates the purification of CPOPv-A from *E. coli* following the methods used in Example 9.

Using methodology described in Example 16, CPOPv-A is assessed for its ability to cleave SNAP-25 in the eDRG cell model. FIG. 26 illustrates that CPOPv-A is able to cleave SNAP-25 in the eDRG model, achieving cleavage of 50% of the maximal SNAP-25 after exposure of the cells to approximately 5.9 nM fusion for 24 h.

Example 28

Preparation of an IgA Protease-Nociceptin Variant-$H_N$/A Fusion Protein

The IgA protease amino acid sequence was obtained from freely available database sources such as GenBank (accession number P09790). Information regarding the structure of the *N. Gonorrhoeae* IgA protease gene is available in the literature (Pohlner et al., Gene structure and extracellular secretion of *Neisseria gonorrhoeae* IgA protease, Nature, 1987, 325 (6103), 458-62). Using Backtranslation tool v2.0 (Entelechon), the DNA sequence encoding the IgA protease modified for *E. coli* expression was determined. A BamHI recognition sequence was incorporated at the 5' end and a codon encoding a cysteine amino acid and SalI recognition sequence were incorporated at the 3' end of the IgA DNA. The DNA sequence was screened using MapDraw, (DNASTAR Inc.) for restriction enzyme cleavage sequences incorporated during the back translation. Any cleavage sequences that are found to be common to those required for cloning were removed manually from the proposed coding sequence ensuring common *E. coli* codon usage is maintained. *E. coli* codon usage was assessed Graphical Codon Usage Analyser (Geneart), and the % GC content and codon usage ratio assessed by reference to published codon usage tables. This optimised DNA sequence (SEQ ID NO:74) containing the IgA open reading frame (ORF) is then commercially synthesized.

The IgA (SEQ ID NO:74) is inserted into the LC-linker-nociceptin variant-spacer-$H_N$ ORF (SEQ ID NO:25) using BamHI and SalI restriction enzymes to replace the LC with the IgA protease DNA. The final construct contains the IgAlinker-nociceptin variant-spacer-H$_N$ ORF (SEQ ID NO:75) for expression as a protein of the sequence illustrated in SEQ ID NO:76.

Example 29

Preparation and Assessment of a Nociceptin Targeted Endopeptidase Fusion Protein with a Removable Histidine Purification Tag DNA was prepared that encoded a Factor Xa removable his-tag (his6), although it is clear that alternative proteases site such as Enterokinase and alternative purification tags such as longer histidine tags are also possible. Using one of a variety of reverse translation software tools (for example EditSeq best *E. coli* reverse translation (DNASTAR Inc.), or Backtranslation tool v2.0 (Entelechon)), the DNA sequence encoding the Factor Xa removable his-tag region is determined. Restriction sites are then incorporated into the DNA sequence and can be arranged as NheI-linker-SpeI-PstI-H$_N$/A-XbaI-LEIEGRSGHHHHHHStop codon-HindIII (SEQ ID NO:77). The DNA sequence is screened for restriction sequence incorporated and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesized (for example by Entelechon, Geneart or Sigma-Genosys) and is provided in the pCR 4 vector. In order to create CPNv-A-FXa-HT (SEQ ID NO:78, removable his-tag construct) the pCR 4 vector encoding the removable his-tag is cleaved with NheI and HindIII. The NheI-HindIII fragment is then inserted into the LC/A-CPNv-H$_N$/A vector (SEQ ID NO:25) that has also been cleaved by NheI and HindIII. The final construct contains the LC/A-linker-nociceptin variant-spacer-H$_N$-FXa-Histag-HindIII ORF sequences (SEQ ID NO:78) for expression as a protein of the sequence illustrated in SEQ ID NO:79. FIG. 27 illustrates the purification of CPNv-A-FXa-HT from *E. coli* following the methods used in Example 9.

Example 30

Preparation of a Leu-Enkephalin Targeted Endopeptidase Fusion Protein Containing a Translocation Domain Derived From Diphtheria Toxin The DNA sequence is designed by back translation of the amino acid sequence of the translocation domain of the diphtheria toxin (obtained from freely available database sources such as GenBank (accession number 1xDTT) using one of a variety of reverse translation software tools (for example EditSeq best *E. coli* reverse translation (DNASTAR Inc.), or Backtranslation tool v2.0 (Entelechon)). Restriction sites are then incorporated into the DNA sequence and can be arranged as NheI-Linker-SpeI-PstI-diphtheria translocation domain-XbaI-stop codon-HindIII (SEQ ID NO:80). PstI/XbaI recognition sequences are incorporated at the 5' and 3' ends of the translocation domain respectively of the sequence maintaining the correct reading frame. The DNA sequence is screened (using software such as MapDraw, DNASTAR Inc.) for restriction enzyme cleavage sequences incorporated during the back translation. Any cleavage sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence containing the diphtheria translocation domain is then commercially synthesized as NheI-Linker-SpeI-PstI-diphtheria translocation domain-XbaI-stop codon-HindIII (for example by Entelechon, Geneart or Sigma-Genosys) and is provided in the pCR 4 vector (Invitrogen). The pCR 4 vector encoding the diphtheria translocation domain is cleaved with NheI and XbaI. The NheI-XbaI fragment is then inserted into the LC/A-CPLE-H$_N$/A vector (SEQ ID NO:68) that has also been cleaved by NheI and XbaI. The final construct contains the LC/A-leu-enkephalin-spacer-diphtheria translocation domain ORF sequences (SEQ ID NO:81) for expression as a protein of the sequence illustrated in SEQ ID NO:82.

Example 31

Preparation of a Nociceptin Variant Targeted Endopeptidase Fusion Protein Containing an LC Domain Derived from Tetanus Toxin The DNA sequence is designed by back translation of the tetanus toxin LC amino acid sequence (obtained from freely available database sources such as GenBank (accession number X04436) using one of a variety of reverse translation software tools (for example EditSeq best *E. coli* reverse translation (DNASTAR Inc.), or Backtranslation tool v2.0 (Entelechon)). BamHI/SalI recognition sequences are incorporated at the 5' and 3' ends respectively of the sequence maintaining the correct reading frame (SEQ ID NO:83). The DNA sequence is screened (using software such as MapDraw, DNASTAR Inc.) for restriction enzyme cleavage sequences incorporated during the back translation. Any cleavage sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence containing the tetanus toxin LC open reading frame (ORF) is then commercially synthesized (for example by Entelechon, Geneart or Sigma-Genosys) and is provided in the pCR 4 vector (Invitrogen). The pCR 4 vector encoding the TeNT LC is cleaved with BamHI and SalI. The BamHI-SalI fragment is then inserted into the LC/A-CPNv-H$_N$/A vector (SEQ ID NO:25) that has also been cleaved by BamHI and SalI. The final construct contains the TeNT LC-linker-nociceptin variant-spacer-H$_N$ ORF sequences (SEQ ID NO:84) for expression as a protein of the sequence illustrated in SEQ ID NO:85.

Example 32

Preparation of an LC/C-nociceptin Variant-H$_N$/C Fusion Protein with a Native Serotype C Linker that Is Susceptible to Factor Xa Cleavage Following the methods used in Example 4, the LC/C (SEQ ID NO:5) and H$_N$/C (SEQ ID NO:6) are created and inserted into the C serotype nociceptin variant linker arranged as BamHI-SalI-linker-nociceptin variant-NheI-spacer-SpeI-PstI-XbaI-stop codon-HindIII (SEQ ID NO:86). The final construct contains the LC-linker-nociceptin variant-spacer-H$_N$ ORF sequences (SEQ ID NO:87) for expression as a protein of the sequence illustrated in SEQ ID NO:88. The fusion protein is termed CPNv-C (act. C).

Example 33

Construction of CHO-K1 OP$_2$ Receptor Activation Assay and SNAP-25 Cleavage Assay Cell-Line Creation CHO OP$_2$ cell line was purchased from Perkin Elmer (ES-541-C, lot 451-719-A). Cells were transfected with SNAP-25 DNA using Lipofectamine™ 2000 and incubated for 4 hours before media replacement. After 24 hours, cells were transferred to a T175 flask. 100 μg/ml Zeocin was added after a further 24 hours to begin selection of SNAP-25 expressing cells, and 5 μg/ml Blasticidin added to maintain selective pressure for the receptor. Cells were maintained in media containing selection agents for two weeks, passaging cells every two to three days to maintain 30-70% confluence. Cells were then diluted in selective media to achieve 0.5 cell per well in a 96 well microplate. After a few days, the plates were examined under a microscope, and those containing single colonies were marked. Media in these wells was changed weekly. As cells became confluent in the wells, they were transferred to T25 flasks. When they had expanded sufficiently each clone was seeded to 24 wells of a 96 well plate, plus a frozen stock vial created. LC/A-CPDY-$H_N$A fusion and LC/A-$H_N$A were applied to the cells for 24 hours, and then Western blots performed to detect SNAP-25 cleavage. Clones from which SNAP-25 bands were strong and cleavage levels were high with fusion were maintained for further investigation. Full dose curves were run on these, and the clone (D30) with the highest differential between LC/A-CPDY-$H_N$A fusion and LC/A-$H_N$A cleavage levels was selected.

$OP_2$ Receptor Activation Assay

The $OP_2$ receptor activation measures the potency and intrinsic efficacy of ligands at $OP_2$ receptor in transfected CHO-K1 cells by quantifying the reduction of forskolin-stimulated intracellular cAMP using a FRET-based cAMP (Perkin Elmer LANCE cAMP kit). After stimulation, a fluorescently labelled cAMP tracer (Europium-streptavadin/biotin-cAMP) and fluorescently (Alexa) labelled anti-cAMP antibody are added to the cells in a lysis buffer. cAMP from the cells competes with the cAMP tracer for antibody binding sites. When read, a light pulse at 320 nm excites the fluorescent portion (Europium) of the cAMP tracer. The energy emitted from the europium is transferred to the Alexa fluor-labelled antibodies bound to the tracer, generating a TR-FRET signal at 665 nm (Time-resolved fluorescence resonance energy transfer is based on the proximity of the donor label, europium, and the acceptor label, Alexa fluor, which have been brought together by a specific binding reaction). Residual energy from the europium produces light at 615 nm. In agonist treated cells there will be less cAMP to compete with the tracer so a dose dependant increase in signal at 665 nm will be observed compared with samples treated with forskolin alone. The signal at 665 nm signal is converted to cAMP concentration by interpolation to a cAMP standard curve which is included in each experiment.

Culture of Cells for Receptor Activation Assay

Cells were seeded and cultured in T175 flasks containing Ham F12 with Glutamax, 10% Foetal bovine serum, 5 μg ml-1 Blasticidin and 100 μg ml-1 Zeocin. The flasks were incubated at 37° C. in a humidified environment containing 5% $CO_2$ until 60-80% confluent. On the day of harvest the media was removed and the cells washed twice with 25 ml PBS. The cells were removed from the flask by addition of 10 ml of TrypLE™ Express, and incubation at 37° C. for 10 min followed by gentle tapping of the flask. The dislodged cells were transferred to a 50 ml centrifuge tube and the flask washed twice with 10 ml media which was added to the cell suspension. The tube was centrifuged at 1300×g for 3 min and the supernatant removed. Cells were gently re-suspended in 10 ml media (if freezing cells) or assay buffer (if using 'fresh' cells in assay), and a sample was removed for counting using a nucleocounter (ChemoMetec). Cells for use 'fresh' in an assay were diluted further in assay buffer to the appropriate concentration. Cells harvested for freezing were re-centrifuged (1300×g; 3 min), the supernatant removed and cells re-suspended in Synth-a-freeze at 4° C. to $3\times10^6$ cells/ml. Cryovials containing 1 ml suspension each were placed in a chilled Nalgene Mr Frosty freezing container (−1° C./minute cooling rate), and left overnight in a −80° C. freezer. The following day vials were transferred to the vapour phase of a liquid nitrogen storage tank.

Dilution of Test Materials and Cell Assay

Using Gilson pipettes and Sigmacote® or lo-bind tips, test materials and standards were diluted to the appropriate concentrations in the wells of the first two columns of an eppendorf 500 μl deep-well lo-bind plate, in assay buffer containing 10 μM forskolin. The chosen concentrations in columns one and two were half a log unit apart. From these, serial 1:10 dilutions were made across the plate (using an electronic eight channel pipette with Sigmacote® or lo-bind tips) until eleven concentrations at half log intervals had been created. In the twelfth column, assay buffer only was added as a 'basal'. Using a 12 channel digital pipette, 10 μl of sample from the lo-bind plate was transferred to the optiplate 96 well microplate.

To wells containing the standard curve, 10 μl of assay buffer was added using a multichannel digital pipette. To wells containing the test materials, 10 μl of cells in assay buffer at the appropriate concentration were added. Plates were sealed and incubated for 120 min at room temperature, for the first hour on an IKA MTS 2/4 orbital shaker set to maximum speed.

Detection

LANCE® Eu-W8044 labeled streptavidin (Eu-SA) and Biotin-cAMP (b-cAMP) were diluted in cAMP Detection Buffer (both from Perkin Elmer LANCE® cAMP kit) to create sub-stocks, at dilution ratios of 1:17 and 1:5, respectively. The final detection mix was prepared by diluting from the two sub stocks into detection buffer at a ratio of 1:125. The mixture was incubated for 15-30 min at room temperature before addition of 1:200 Alexa Fluor® 647-anti cAMP Antibody (Alexa-Fluor Ab). After briefly vortex mixing, 20 μl was immediately added to each well using a digital multichannel pipette. Microplate sealers were applied and plates incubated for 24 h at room temperature (for the first hour on an IKA MTS 2/4 orbital shaker set to maximum speed). Plate sealers were removed prior to reading on the Envision.

FIGS. 33 and 34 show that dynorphin conjugates with LC/A-$H_N$/A, LC/B-$H_N$/B, LC/C-$H_N$/C and LC/D-$H_N$/D backbones active the $OP_2$ receptor.

CHO-K1 OP2 SNAP-25 Cleavage Assay

Cultures of cells were exposed to varying concentrations of fusion protein for 24 hours. Cellular proteins were separated by SDS-PAGE and Western blotted with anti-SNAP-25 antibody to facilitate assessment of SNAP-25 cleavage. SNAP-25 cleavage calculated by densitometric analysis (Syngene).

Plating Cells

Prepare cells at $2\times10^5$ cells/ml and seed 125 μl per well of 96 well plate. Use the following media: 500 ml Gibco Ham F12 with Glutamax® (product code 31765068), 50 ml FBS, 5 μg/ml Blasticidin (250 μl aliquot from box in freezer, G13) (Calbiochem #203351, 10 ml at 10 mg/ml), 100 μg/ml Zeocin (500 μl from box in freezer, G35). (Invitrogen from Fisher, 1 g in 8×1.25 ml tubes at 100 mg/ml product code VXR25001). Allow cells to grow for 24 hrs (37° C., 5% $CO_2$, humidified atmosphere).

Cell Treatment Prepare dilutions of test protein for a dose range of each test proteins (make up double (2×) the desired final concentrations because 125 µl will be applied directly onto 125 µl of media already in each well). Filter sterilize CHO KOR D30 feeding medium (20 ml syringe, 0.2 µm syringe filter) to make the dilutions. Add the filtered medium into 5 labelled bijoux's (7 ml tubes), 0.9 ml each using a Gilson pipette or multi-stepper. Dilute the stock test protein to 2000 nM (working stock solution 1) and 600 nM (working stock solution 2). Using a Gilson pipette prepare 10-fold serial dilutions of each working stock, by adding 100 µl to the next concentration in the series. Pipette up and down to mix thoroughly. Repeat to obtain 4 serial dilutions for solution 1, and 3 serial dilutions for solution 2. A 0 nM control (filtered feeding medium only) should also be prepared as a negative control for each plate. Repeat the above for each test protein. In each experiment a 'standard' batch of material must be included as control/reference material, this is unliganded LC/A-$H_N$/A.

Apply Diluted Sample to CHO KOR D30 Plates

Apply 125 µl of test sample (double concentration) per well. Each test sample should be applied to triplicate wells and each dose range should include a 0 nM control. Incubate for 24 hrs (37° C., 5% $CO_2$, humidified atmosphere).

Cell Lysis

Prepare fresh lysis buffer (20 mls per plate) with 25% (4×) NuPAGE® LDS sample buffer, 65% $dH_2O$ and 10% 1 M DTT. Remove medium from the CHO KOR D30 plate by inverting over a waste receptacle. Drain the remaining media from each well using a fine-tipped pipette. Lyse the cells by adding 125 µl of lysis buffer per well using a multi-stepper pipette. After a minimum of 20 mins, remove the buffer from each well to a 1.5 ml microcentrifuge tube. Tubes must be numbered to allowing tracking of the CHO KOR treatments throughout the blotting procedure. A1-A3 down to H1-H3 numbered 1-24, A4-A6 down to H4-H6 numbered 25-48, A7-A9 down to H7-H93 numbered 49-72, A10-A12 down to H10-H12 numbered 73-96. Vortex each sample and heat at 90° C. for 5-10 mins in a prewarmed heat block. Store at −20° C. or use on the same day on an SDS gel.

Gel Electrophoresis

If the sample has been stored o/n or longer, put in a heat block prewarmed to 90° C. for 5-10 mins. Set up SDS page gels, use 1 gel per 12 samples, prepare running buffer (1×, Invitrogen NuPAGE® MOPS SDS Running Buffer (20×) (NP0001)) approximately 800 ml/gel tank. Add 500 µl of NuPAGE® antioxidant to the upper buffer chamber. Load 15 µl samples onto gel lanes from left to right as and load 2.5 µl of Invitrogen Magic Marker XP and 5 µl Invitrogen See Blue Plus 2 pre-stained standard and 15 µl of non-treated control. It is important to maximize the resolution of separation during SDS PAGE. This can be achieved by running 12% bis-tris gels at 200 V for 1 hour and 25 minutes (until the pink (17 kDa) marker reaches the bottom of the tank).

Western Blotting

Complete a Semi-dry transfer: using an Invitrogen iBlot® (use iBlot Programme 3 for 6 minutes). Put the nitrocellulose membranes in individual small trays. Incubate the membranes with blocking buffer solution (5 g Marvel® milk powder per 100 ml 0.1% PBS/Tween) at room temperature, on a rocker, for 1 hour. Apply primary antibody (Anti-SNAP-25 1:1000 dilution) and incubate the membranes with primary antibody (diluted in blocking buffer) for 1 hour on a rocker at room temperature. Wash the membranes by rinsing 3 times with PBS/Tween (0.1%). Then apply the secondary (Anti-Rabbit-HRP conjugate diluted 1:1000) and incubate the membranes with secondary antibody (diluted in blocking buffer) at room temperature, on a rocker, for 1 hour. Wash the membranes by rinsing 3 times with PBS/Tween (0.1%), leave membrane a minimum of 20 mins for the last wash. Detect the bound antibody using Syngene: Drain blots of PBS/Tween, mix WestDura reagents 1:1 and add to blots for 5 minutes. Ensure enough solution is added to the membranes to completely cover them. Place membrane in Syngene tray, set up Syngene software for 5 min expose time.

FIG. 31 clearly shows that LC/A-CPDY-$H_N$/A conjugates effectively cleave SNAP-25.

Example 34

Construction and Activation of Dynorphin Fusion Proteins

Preparation of a LC/A and $H_N$/A Backbone Clones

The following procedure creates the LC and $H_N$ fragments for use as the component backbone for multidomain fusion expression. This example is based on preparation of a sero-type A based clone (SEQ ID NO:1 and SEQ ID NO:2), though the procedures and methods are equally applicable to the other serotypes (illustrated by the sequence listing for serotype B (SEQ ID NO:3 and SEQ ID NO:4) and serotype C (SEQ ID NO:5 and SEQ ID NO:6)).

Preparation of Cloning and Expression Vectors pCR 4 (Invitrogen) is the chosen standard cloning vector, selected due to the lack of restriction sequences within the vector and adjacent sequencing primer sites for easy construct confirmation. The expression vector is based on the pMAL (NEB) expression vector, which has the desired restriction sequences within the multiple cloning site in the correct orientation for construct insertion (BamHI-SalI-PstI-HindIII). A fragment of the expression vector has been removed to create a non-mobilisable plasmid and a variety of different fusion tags have been inserted to increase purification options.

Preparation of Protease (e.g., LC/A) Insert

The LC/A (SEQ ID NO:1) is created by one of two ways:

The DNA sequence is designed by back translation of the LC/A amino acid sequence (obtained from freely available database sources such as GenBank (accession number P10845) or Swissprot (accession locus BXA1_CLOBO) using one of a variety of reverse translation software tools (for example EditSeq best *E. coli* reverse translation (DNASTAR Inc.), or Backtranslation tool v2.0 (Entelechon)). BamHI/SalI recognition sequences are incorporated at the 5' and 3' ends respectively of the sequence, maintaining the correct reading frame. The DNA sequence is screened (using software such as MapDraw, DNASTAR Inc.) for restriction enzyme cleavage sequences incorporated during the back translation. Any cleavage sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence containing the LC/A open reading frame (ORF) is then commercially synthesized (for example by Entelechon, Geneart or Sigma-Genosys) and is provided in the pCR 4 vector.

The alternative method is to use PCR amplification from an existing DNA sequence with BamHI and SalI restriction enzyme sequences incorporated into the 5' and 3' PCR primers respectively. Complementary oligonucleotide primers are chemically synthesised by a supplier (for example MWG or Sigma-Genosys), so that each pair has the ability to hybridize to the opposite strands (3' ends pointing "towards" each other) flanking the stretch of *Clostridium* target DNA, one oligonucleotide for each of the two DNA strands. To generate a PCR product the pair of short oligonucleotide primers specific for the *Clostridium* DNA sequence are mixed with the *Clostridium* DNA template and other reaction components and placed in a machine (the 'PCR machine') that can change the incubation temperature of the reaction tube automatically, cycling between approximately 94° C. (for denaturation), 55° C. (for oligonucleotide annealing), and 72° C. (for synthesis). Other reagents required for amplification of a PCR product include a DNA polymerase (such as Taq or Pfu polymerase), each of the four nucleotide dNTP building blocks of DNA in equimolar amounts (50-200 μM) and a buffer appropriate for the enzyme optimised for $Mg^{2+}$ concentration (0.5-5 mM).

The amplification product is cloned into pCR 4 using either, TOPO® TA cloning for Taq PCR products or Zero Blunt® TOPO® cloning for Pfu PCR products (both kits commercially available from Invitrogen). The resultant clone is checked by sequencing. Any additional restriction sequences which are not compatible with the cloning system are then removed using site directed mutagenesis (for example, using Quickchange® (Stratagene Inc.)).

Preparation of Translocation (e.g., $H_N$) Insert

The $H_N$/A (SEQ ID NO:2) is created by one of two ways:

The DNA sequence is designed by back translation of the $H_N$/A amino acid sequence (obtained from freely available database sources such as GenBank (accession number P10845) or Swissprot (accession locus BXA1_CLOBO)) using one of a variety of reverse translation software tools (for example EditSeq best *E. coli* reverse translation (DNASTAR Inc.), or Backtranslation tool v2.0 (Entelechon)). A PstI restriction sequence added to the N-terminus and XbaI-stop codon-HindIII to the C-terminus ensuring the correct reading frame is maintained. The DNA sequence is screened (using software such as MapDraw, DNASTAR Inc.) for restriction enzyme cleavage sequences incorporated during the back translation. Any sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesised (for example by Entelechon, Geneart or Sigma-Genosys) and is provided in the pCR 4 vector.

The alternative method is to use PCR amplification from an existing DNA sequence with PstI and XbaI-stop codon-HindIII restriction enzyme sequences incorporated into the 5' and 3' PCR primers respectively. The PCR amplification is performed as described above. The PCR product is inserted into pCR 4 vector and checked by sequencing. Any additional restriction sequences which are not compatible with the cloning system are then removed using site directed mutagenesis (for example using Quickchange® (Stratagene Inc.)).

Preparation of Linker-Dynorphin-Spacer Insert

The LC-$H_N$ linker can be designed from first principle, using the existing sequence information for the linker as the template. For example, the serotype A linker (in this case defined as the inter-domain polypeptide region that exists between the cysteines of the disulphide bridge between LC and $H_N$) is 23 amino acids long and has the sequence VRGI-ITSKTKSLDKGYNKALNDL (SEQ ID NO:164). Within this sequence, it is understood that proteolytic activation in nature leads to an $H_N$ domain that has an N-terminus of the sequence ALNDL (SEQ ID NO:165). This sequence information is freely available from available database sources such as GenBank (accession number P10845) or Swissprot (accession locus BXA1 CLOBO). Into this linker an enterokinase site, dynorphin and spacer are incorporated; and using one of a variety of reverse translation software tools [for example, EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-SafI-linker-protease site-dynorphin-NheI-spacer-SpeI-PstI-XbaI-stop codon-HindIII. It is important to ensure the correct reading frame is maintained for the spacer, dynorphin and restriction sequences and that the XbaI sequence is not preceded by the bases, TC, which would result on DAM methylation. The DNA sequence is screened for restriction sequence incorporation, and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example, GenBank Release 143, 13 Sep. 2004). This optimised DNA sequence is then commercially synthesized (for example, by Entelechon, Geneart or Sigma-Genosys) and is provided in the pCR 4 vector.

Preparation of the LC/A-dynorphin-$H_N$/A Fusion

In order to create the LC-linker-dynorphin-spacer-$H_N$ construct (SEQ ID NO:90), the pCR 4 vector encoding the linker-dynorphin-spacer is cleaved with BamHI+SalI restriction enzymes. This cleaved vector then serves as the recipient vector for insertion and ligation of the LC/A DNA (SEQ ID NO:1) cleaved with BamHI+SalI. The resulting plasmid DNA is then cleaved with PstI+XbaI restriction enzymes and serves as the recipient vector for the insertion and ligation of the $H_N$/A DNA (SEQ ID NO:2) cleaved with PstI+XbaI. The final construct contains the LC-linker-dynorphin-spacer-$H_N$ ORF (SEQ ID NO:90) for transfer into expression vectors for expression to result in a fusion protein of the sequence illustrated in SEQ ID NO:91.

Examples 35

Preparation and Purification of an LC/A-dynorphin-$H_N$/A Fusion Protein Family with Variable Spacer Length Using the same strategy as employed in Example 34, a range of DNA linkers were prepared that encoded dynorphin and variable spacer content. Using one of a variety of reverse translation software tools (for example EditSeq best *E. coli* reverse translation (DNASTAR Inc.), or Backtranslation tool v2.0 (Entelechon)), the DNA sequence encoding the linker-ligand-spacer region is determined. Restriction sites are then incorporated into the DNA sequence and can be arranged as BamHI-SalI-linker-protease site-dynorphin-NheI-spacer-SpeI-PstI-XbaI-stop codon-HindIII. It is important to ensure the correct reading frame is maintained for the spacer, dynorphin and restriction sequences and that the XbaI sequence is not preceded by the bases, TC which would result on DAM methylation. The DNA sequence is screened for restriction sequence incorporation and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesized (for example by Entelechon, Geneart or Sigma-Genosys) and is provided in the pCR 4 vector.

The spacers that were created included:

| Code | Protein sequence of the linker | SEQ ID NO of the linker DNA |
|---|---|---|
| GS10 | ALAGGGGSALVLQ | 92 |
| GS15 | ALAGGGGSGGGGSALVLQ | 93 |
| GS25 | ALAGGGGSGGGGSGGGGSGGGGSALVLQ | 94 |
| GS30 | ALAGGGGSGGGGSGGGGSGGGGSGGGGSALV | 98 |
| Hx27 | ALAAEAAAKEAAAKEAAAKAGGGGSALV | 99 |

By way of example, in order to create the LC/A-CPDY (GS25)-$H_N$/A fusion construct (SEQ ID NO:94), the pCR 4 vector encoding the linker is cleaved with BamHI+SalI restriction enzymes. This cleaved vector then serves as the recipient vector for insertion and ligation of the LC/A DNA (SEQ ID NO:1) also cleaved with BamHI+SalI. The resulting plasmid DNA is then cleaved with BamHI+HindIII restriction enzymes and the LC/A-linker fragment inserted into a similarly cleaved vector containing a unique multiple cloning site for BamHI, SalI, PstI, and HindIII such as the pMAL vector (NEB). The $H_N$/A DNA (SEQ ID NO:2) is then cleaved with PstI+HindIII restriction enzymes and inserted into the similarly cleaved pMAL-LC/A-linker construct. The final construct contains the LC/A-CPDY(GS25)-$H_N$/A ORF for expression as a protein of the sequence illustrated in SEQ ID NO:94.

Example 36

Purification Method for LC/A-dynorphin-$H_N$/A Fusion Protein

Defrost falcon tube containing 25 ml 50 mM HEPES pH 7.2, 200 mM NaCl and approximately 10 g of *E. coli* BL21 cell paste. Make the thawed cell paste up to 80 ml with 50 mM HEPES pH 7.2, 200 mM NaCl and sonicate on ice 30 seconds on, 30 seconds off for 10 cycles at a power of 22 microns ensuring the sample remains cool. Spin the lysed cells at 18 000 rpm, 4° C. for 30 minutes. Load the supernatant onto a 0.1 M $NiSO_4$ charged Chelating column (20-30 ml column is sufficient) equilibrated with 50 mM HEPES pH 7.2, 200 mM NaCl. Using a step gradient of 10 and 40 mM imidazol, wash away the non-specific bound protein and elute the fusion protein with 100 mM imidazol. Dialyse the eluted fusion protein against 5 L of 50 mM HEPES pH 7.2, 200 mM NaCl at 4° C. overnight and measure the OD of the dialysed fusion protein. Add 3.2 µl of enterokinase (2 µg/ml) per 1 mg fusion protein and Incubate at 25° C. static overnight. Load onto a 0.1 M $NiSO_4$ charged Chelating column (20-30 ml column is sufficient) equilibrated with 50 mM HEPES pH 7.2, 200 mM NaCl. Wash column to baseline with 50 mM HEPES pH 7.2, 200 mM NaCl. Using a step gradient of 10 and 40 mM imidazol, wash away the non-specific bound protein and elute the fusion protein with 100 mM imidazol. Dialyse the eluted fusion protein against 5 L of 50 mM HEPES pH 7.2, 200 mM NaCl at 4° C. overnight and concentrate the fusion to about 2 mg/ml, aliquot sample and freeze at −20° C. Test purified protein using OD, BCA, purity analysis and SNAP-25 assessments.

Example 37

Preparation of an LC/C-dynorphin-$H_N$/C FUSION Protein with a Serotype A Activation Sequence Following the methods used in Examples 1 and 2, the LC/C (SEQ ID NO:5) and $H_N$/C (SEQ ID NO:6) are created and inserted into the A serotype linker arranged as BamHI-SalI-linker-protease site-dynorphin-NheI-spacer-SpeI-PstI-XbaI-stop codon-HindIII. The final construct contains the LC-linker-dynorphin-spacer-$H_N$ ORF for expression as a protein of the sequence illustrated in SEQ ID NO:95.

Example 38

Preparation of an IGA Protease-Dynorphin Variant-$H_N$/A Fusion Protein

The IgA protease amino acid sequence was obtained from freely available database sources such as GenBank (accession number P09790). Information regarding the structure of the *N. Gonorrhoeae* IgA protease gene is available in the literature (Pohlner et al., Gene structure and extracellular secretion of *Neisseria gonorrhoeae* IgA protease, Nature, 1987, 325 (6103), 458-62). Using Backtranslation tool v2.0 (Entelechon), the DNA sequence encoding the IgA protease modified for *E. coli* expression was determined. A BamHI recognition sequence was incorporated at the 5' end and a codon encoding a cysteine amino acid and SalI recognition sequence were incorporated at the 3' end of the IgA DNA. The DNA sequence was screened using MapDraw, (DNASTAR Inc.) for restriction enzyme cleavage sequences incorporated during the back translation. Any cleavage sequences that are found to be common to those required for cloning were removed manually from the proposed coding sequence ensuring common *E. coli* codon usage is maintained. *E. coli* codon usage was assessed Graphical Codon Usage Analyser (Geneart), and the % GC content and codon usage ratio assessed by reference to published codon usage tables. This optimised DNA sequence (SEQ ID NO:74) containing the IgA open reading frame (ORF) is then commercially synthesized.

The IgA (SEQ ID NO:74) is inserted into the LC-linker-dynorphin-spacer-$H_N$ ORF (SEQ ID NO:90) using BamHI and SalI restriction enzymes to replace the LC with the IgA protease DNA. The final construct contains the IgA-linker-dynorphin-spacer-$H_N$ ORF for expression as a protein of the sequence illustrated in SEQ ID NO:96.

Example 39

Preparation of a Dynorphin Targeted Endopeptidase Fusion Protein Containing an LC Domain Derived from Tetanus Toxin The DNA sequence is designed by back translation of the tetanus toxin LC amino acid sequence (obtained from freely available database sources such as GenBank (accession number X04436) using one of a variety of reverse translation software tools [for example EditSeq best *E. coli* reverse translation (DNASTAR Inc.), or Backtranslation tool v2.0 (Entelechon)]. BamHI/SalI recognition sequences are incorporated at the 5' and 3' ends respectively of the sequence maintaining the correct reading frame (SEQ ID NO:83). The DNA sequence is screened (using software such as MapDraw, DNASTAR Inc.) for restriction enzyme cleavage sequences incorporated during the back translation. Any cleavage sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence containing the tetanus toxin LC open reading frame (ORF) is then commercially synthesized (for example by Entelechon, Geneart or Sigma-Genosys) and is provided in the pCR 4 vector (Invitrogen). The pCR 4 vector encoding the TeNT LC is cleaved with BamHI and SalI. The BamHI-SalI fragment is then inserted into the LC/A-dynorphin-$H_N$/A vector (SEQ ID NO:90) that has also been cleaved by BamHI and SalI. The final construct contains the TeNT LC-linker-dynorphin-spacer-$H_N$ ORF sequences for expression as a protein of the sequence illustrated in SEQ ID NO:97.

Examples 40

Preparation and Purification of an LC/A-dynorphin-$H_N$/A Fusion Protein Family with Variable Dynorphin Ligands Using the same strategy as employed in Example 34, a range of DNA Dynorphin ligands were prepared that encoded various dynorphin ligands. Using one of a variety of reverse translation software tools (for example EditSeq best E. coli reverse translation (DNASTAR Inc.), or Backtranslation tool v2.0 (Entelechon)), the DNA sequence encoding the linker-ligand-spacer region is determined. Restriction sites are then incorporated into the DNA sequence and can be arranged as BamHI-SalI-linker-protease site-dynorphin ligand-NheI-spacer-SpeI-PstI-XbaI-stop codon-HindIII. It is important to ensure the correct reading frame is maintained for the spacer, dynorphin ligand and restriction sequences and that the XbaI sequence is not preceded by the bases, TC which would result on DAM methylation. The DNA sequence is screened for restriction sequence incorporation and any additional sequences are removed manually from the remaining sequence ensuring common E. coli codon usage is maintained. E. coli codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesized (for example by Entelechon, Geneart or Sigma-Genosys) and is provided in the pCR 4 vector.

Alternatively, the dynorphin ligand was created by performing site-directed mutagenesis on the DNA sequence of LC/A-CPDY-HN/A fusion (SEQ ID NO:90).

The ligands that were created included:

| Dynorphin Ligand | Protein sequence of the Dynorphin ligands | SEQ ID NO of the Dynorphin ligand |
|---|---|---|
| CPDY1-13 | YGGFLRRIRPKLK | 101 |
| CPDY (D15A) | YGGFLRRIRPKLKWANQ | 102 |
| CPDY (I8RP10R) 1-13 | YGGFLRRIRPKLK | 106 |
| CPDY (I8RP1-RD15A) | YGGFLRRRRRKLKWANQ | 105 |
| CPDNv9 | YGGFLGARKSARKRKNQ | 107 |

By way of example, in order to create the LC/A-CPDY (D15A)-GS20-$H_N$/A fusion construct (SEQ ID NO:102), the pCR 4 vector encoding the fusion protein (SEQ ID NO:90) serves as a template for site-directed mutagenesis to mutate the aspartic acid residue at position 15 within the dynorphin ligand to alanine. A forward and reverse primer was designed and synthesised that were complementary to the template DNA apart but encoded a mismatch to incorporate the required mutation. 125 ng primers, 1 µl dNTPs, 5-50 ng template DNA, 5 µl of 10× reaction buffer and 1µ Pfu polymerase (2.5 U/µl) were added to a 50 µl reaction mixture. The PCR reaction was as follows: 95° C. for 2 min, then 24 cycles of 95° C. for 1 min, 55° C. annealing for 1 min, 68° C. final extension for 8 min, then a 4° C. hold. The DNA product was then transformed into TOP10 cells and the plasmid DNA from the resulting colonies was then purified and sequenced to confirm that the dynorphin ligand had been mutated to create a DNA construct that will give the ORF LC/A-CPDY (D15A)-GS20-$H_N$/A (SEQ ID NO:102).

Purification of Purification of an LC/A-dynorphin-$H_N$/A Fusion Protein Family with Variable Dynorphin Ligands Defrost falcon tube containing 25 ml 50 mM HEPES pH 7.2, 200 mM NaCl and approximately 10 g of E. coli BL21 cell paste. Make the thawed cell paste up to 80 ml with 50 mM HEPES pH 7.2, 200 mM NaCl and The cell paste was then homogenised at 20,000 psi by a Constant System Homogeniser. Spin the lysed cells at 18 000 rpm, 4° C. for 30 minutes. Load the supernatant onto a 0.1 M $NiSO_4$ charged Chelating column (20-30 ml column is sufficient) equilibrated with 50 mM HEPES pH 7.2, 200 mM NaCl. Using a step gradient of 10 and 40 mM imidazol, wash away the non-specific bound protein and elute the fusion protein with 100 mM imidazol. Dialyse the eluted fusion protein against 5 L of 50 mM HEPES pH 7.2, 200 mM NaCl at 4° C. overnight and measure the OD of the dialysed fusion protein. Add 3.2 µl of enterokinase (2 µg/ml) per 1 mg fusion protein and Incubate at 25° C. static overnight. Activated samples were then subjected to hydrophobic interaction chromatography (HIC purification). Solid ammonium sulphate was slowly added by spatula to the activated fusion protein and stirred by a magnetic flea at room temperature to dissolve the solid. More ammonium sulphate was added once the previous addition had been dissolved and this was repeated until the concentration reached 1 M. Load onto a Phenyl sepharose 6 fast flow (20-30 ml column is sufficient) equilibrated with 50 mM HEPES pH 7.2, 1 M ammonium sulphate. The column was then washed with 50 mM HEPES pH 7.2, 1 M ammonium sulphate. Bound protein was eluted by reducing the ammonium sulphate concentration to 0.7 M, 0.5 M, 0.3 M and 0 M and collected in 10 ml fractions. Dialyse the eluted fusion protein against 10 L of 50 mM HEPES pH 7.2, 200 mM NaCl at 4° C. overnight and concentrate the fusion to about 2 mg/ml, aliquot sample and freeze at −20° C. Test purified protein using OD, BCA, purity analysis and SNAP-25 assessments.

Examples 41

Preparation and Purification of an LC/A-dynorphin1-13-$H_N$/A (GS30) and LC/A-dynorphin1(D 15A)-$H_N$/A (GS30) Fusion Protein Using the constructs described in Examples 34 and Example 40, LC/A-dynorphin1-13-$H_N$/A (GS30) and LC/A-dynorphin1(D15A)-$H_N$/A (GS30) DNA encoding fusion proteins (SEQ ID NOS:104 and 103) were created by sub-cloning experiments. By way of an example, the DNA encoding LC/A-dynorphin1(D15A)-HN/A fusion protein (SEQ ID NO:102) was digested with the restriction enzymes NheI and HindIII to remove the GS20 spacer and heavy chain. DNA encoding LC/A-dynorphin-HN/A (GS30) fusion protein (SEQ ID NO:98) was also digested with NheI and HindIII to produce a GS30-$H_N$/A fragment. Vector backbone and fragment DNA was separated by running on a 1% agarose gel at 150 volts for 1 hour before the DNA was purified with a gel extraction kit. The GS30-$H_N$/A fragment was then ligated into the vector backbone of digested LC/A-dynorphin1 (D15A)-$H_N$/A fusion protein (SEQ ID NO:102) to produce LC/A-dynorphin1(D15A)-$H_N$/A (GS30) fusion protein. Typical ligation reactions were set up as follows: 2 µl Vector DNA, 14 µl Insert DNA, 2 µl 10×T4 ligase buffer, 2 µl T4 ligase. Ligation reactions were left overnight at 16° C.

Purification of LC/A-dynorphin1-13-H$_N$/A (GS30) and LC/A-dynorphin1(D15A)-H$_N$/A (GS30) Fusion Protein The fusion proteins were purified as described in Example 40.

Example 42

Preparation of an LC/B-dynorphin-H$_N$/B Fusion Protein with a Serotype A Activation Sequence Following the methods used in Examples 1 and 2, the LC/B (SEQ ID NO:3) and H$_N$/B (SEQ ID NO:4) were created and inserted into the A serotype linker arranged as BamHI-SalI-linker-protease site-dynorphin-NheI-spacer-SpeI-PstI-XbaI-stop codon-HindIII. The final construct contained the LB-linker-dynorphin-spacer-H$_N$/B ORF for expression as a protein of the sequence illustrated in SEQ ID NO:100.

Example 43

Construction of CHO-K1 MrgX1 Receptor Activation Ca2+ Fluorimetry Assay

Cell-Line Culture

CHO-K1 MrgX1 Cell Line cells were purchased from Perkin Elmer (Perkin Elmer ES-740-A). Cell culture media used was F-12 HAMS+Glutamax with 10% Foetal bovine serum and 800 μg/ml Geneticin. Cells were grown in continuous culture in T500 flasks. Subconfluent cultures (70-80%) confluent were split at a ratio 1:40 every 3-4 days. Then the culture medium was removed from the cells and the cells washed twice with 30 ml PBS. Cells were then removed from the flask by addition of 30 ml of PBS-based enzyme free dissociation buffer, and incubated at 37° C. for 5 min followed by gentle tapping of the flasks to dislodge cells. Added 10-20 ml of culture media to the flasks and transferred the remaining cells to a 50 ml tube. Washed the flask with 10-20 ml culture media and added this to the cell suspension. Cells were then centrifuged at 1300 rpm for 3 min in a Heraeus megafuge 1.0 to pellet cells before removing the supernatant and resuspending the cell pellet in culture media. Cells were then diluted further with culture media to achieve a split ratio of 1:40 and transferred appropriate volume of cells to a T500 flask. The number of cells present were counted using the Nucleocounter. Cells were then pelleted by centrifugation at 1,300 rpm for 3 min in a Heraeus megafuge 1.0 and the pellet re-suspend in Bambanker freezing medium to achieve a concentration of 3×10$^6$ cells/ml. After aliquoting the cell suspension into 1.8 ml Nunc cryovials, the vials were transferred to a cryo vial rack and store at −80° C. overnight before transferring the vials to the short-term liquid nitrogen store. Several cell passage numbers were frozen in liquid nitrogen for use in the assay. Maximum passage number to be used in the assay is Px+16.

Resurrection and Plating CHO-K1-MrgX1 Cells

This assay was optimized for the use of frozen cells. Plated cells approximately 16 h before the assay performed. Removed cell vials from liquid nitrogen and thawed quickly by placing vials in a 37° C. water bath. Transferred cells to a centrifuge tube containing 10 ml growth media for each vial being resurrected. Pelleted the cells by centrifuging at 1,300 rpm for 3 min in a Heraeus megafuge 1.0. Then the cell pellet was re-suspend in 2 ml media/vial and the number of viable cells in the suspension counted using a Nucleocounter before adding media to the cell suspension to achieve a cell concentration of 1×10$^6$ cells/ml. Then the cells were plated in a Corning black walled, clear-bottom, half-area plate at a density of 20,000 viable cells/well by using a Rainin E8-300 multi-channel pipette to firstly add 30 μl media to each well followed by 20 μl/well of the 1×10$^6$ cells/ml cell suspension. Cells were plated 16-18 h prior to the beginning of the assay and the plates maintain under normal growth conditions in a 37° C. 5% CO$_2$ incubator.

HBSS Assay Buffer Preparation

Added 1.26 mmol.L$^{-1}$ CaCl$_2$ (630 μl of 1 mol/L CaCl$_2$), 0.49 mmol/L MgCl$_2$ (245 of 1 mol/L MgCl$_2$), 0.4 mmol/L MgSO$_4$ (203 μl of 1 mol/L MgSO$_4$), 20 mmol/L HEPES (10 ml of 1 mol/L HEPES) to 500 ml HBSS. Adjust the pH of the HBSS buffer to pH 7.4 at room temperature using NaOH. Filter sterilise the HBSS buffer in a sterile hood. On the day of the assay, prepared a fresh stock of Probenecid at 500 mmol/L by dissolving 710 mg of Probenecid (MW: 285.36) in 5 ml of 1 mol/L NaOH. Assay buffer was made by adding the appropriate volume of 500 mmol/L Probenecid to HBSS buffer required for the assay plate (final concentration, 5 mmol/L) and the ligand dilution series (2.5 mmol/L final concentration). To the 5 mmol/L Probenecid/HBSS assay buffer added a volume of 10% BSA that gives a final concentration of 0.02% BSA. Used the same solution of 5 mmol/L Probenecid/0.02% BSA assay buffer to dilute 1 in 2 in HBSS to make a 2.5 mmol/L Probenecid/0.01% BSA solution for ligand dilution.

Calcium-3 Dye Preparation

Added 10 ml HBSS buffer to a bottle of desiccated Ca$^{2+}$-4 dye. Vortexed hard and transfer to a 100 ml container. Repeated this 9 times so that a total of 100 ml HBSS buffer had been added to the Ca$^{2+}$-4 dye. Aliquoted the dye into 10 ml aliquots and stored at −20° C. When using a frozen aliquot, the vial was removed from −20° C. freezer and warmed in a 37° C. waterbath. After thawing the necessary number of vials of Ca$^{2+}$-4 dye, it was diluted 1:2 with HBSS buffer to attain 0.5×Ca$^{2+}$-4 dye.

Dilution of Test Fusions

Prepared the source plate, containing ligand or fusion, prior to loading cells and beginning their incubation. All reference ligand concentration ranges were achieved by serial dilution in half-log 10 increments using Sigmacote® tips. The reference compound BAM (8-22) was included in every assay at a concentration range of 5×10$^{-6}$ M (5 μM) to 5×10$^{-11}$ M (50 μM) (final assay concentration will be 5× lower) plus basal (1×10$^{-14}$). Fusions to be tested were included in every assay at a concentration range of 5×10$^{-6}$ M to 5×10$^{-9}$ M (final assay concentration will be 5× lower).

Prepared an intermediate 50 μmol/L stock of BAM (8-22) by 1 in 10 dilution in HBSS assay buffer (2.5 mmol/L Probenecid; 0.01% BSA HBSS assay buffer) of 500 μmol/ stock using lo-bind Eppendorf tubes and Gilson P20 and P100 pipettes. Then, transfer 50 μL of the 50 μmol/L intermediate stock to the first well of a 0.5 ml lo-bind 96-well plate containing 450 μL of HBSS buffer and performed the ligand dilution series creating 1:10 dilution series going down the plate.

The assay was optimized for the source plate layout in rows, therefore the source of the dilution series must be split into triplicates (minimum of 50 μL to allow FlexStation3® to transfer 25 μL) in a separate 0.5 ml lo-bind 96-well plate (×2 compounds per plate). This can be transferred directly to the FlexStation3 for ligand transfer using Sigmacote® FlexStation3® tips (Molecular Devices).

Dye Loading of Cells

Removed culture media from the half area 96-well plates containing cells, incubated overnight using a Rainin L50 pipette, taking care not to disrupt cells. Add 50 μl of assay buffer followed by 50 μl of 0.5×$Ca^{2+}$ dye using an electronic multichannel pipette E8-300. Incubate cells at 37° C. in 5% $CO_2$ for 120 min.

FlexStation 3® Readings

The human mas-related G-protein coupled receptor member X1 belongs to the family of orphan G protein-coupled receptors. Predominantly coupled through Gαq/11, receptor activation by an agonist causes Gαq protein activation resulting in $Ca^{2+}$ release from intracellular stores that is mediated by the target enzyme phospholipase CB. The transient increase in intracellular $Ca^{2+}$ requires a real-time (RT), simultaneous inject-and-read system to measure $Ca^{2+}$ flux. The FlexStation3® microplate reader with integrated fluid transfer is used in this assay for this purpose. CHO cells that express the recombinant human MrgX1 receptor are incubated with the proprietary FLIPR-Calcium-4 masking dye that minimises background signal from extracellular $Ca^{2+}$ and makes washing cells unnecessary. The $Ca^{2+}$-4 dye forms a complex with $Ca^{2+}$ which fluoresces at 525 nm following excitation at 485 nm allowing signal-detection. An inhibitor of cell membrane anion exchanger, Probenecid, is included in the assay buffer to prevent outward transport or sequestration of dye molecules. Following incubation with the dye, the cell plate is loaded onto to the FlexStation3® which transfers ligands (reference agonist or fusions) from a source plate into the microplate wells containing cells. The FlexStation 3® measures the fluorescent-emission from the Calcium-4 dye and readouts are formed as calcium traces displaying the magnitude of calcium flux as a result of MrgX1 receptor activation.

Example 44

Construction and Activation of BAM Fusion Proteins

To construct fusions that contain BAM1-22 (SEQ ID NO:108) and BAMS-22 (SEQ ID NO:109) the preparation of a LC/A and $H_N$/A backbone clones and preparation of cloning and expression vectors are identical as those described in Example 34.

Preparation of Linker-BAM-Spacer Insert

The LC-$H_N$ linker can be designed from first principle, using the existing sequence information for the linker as the template. For example, the serotype A linker (in this case defined as the inter-domain polypeptide region that exists between the cysteines of the disulphide bridge between LC and $H_N$) is 23 amino acids long and has the sequence VRGI-ITSKTKSLDKGYNKALNDL (SEQ ID NO:164). Within this sequence, it is understood that proteolytic activation in nature leads to an $H_N$ domain that has an N-terminus of the sequence ALNDL (SEQ ID NO:165). This sequence information is freely available from available database sources such as GenBank (accession number P10845) or Swissprot (accession locus BXA1 CLOBO). Into this linker an enterokinase site, BAM ligand (SEQ ID NO 108 and SEQ ID NO 109) and spacer are incorporated; and using one of a variety of reverse translation software tools [for example, EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-SalI-linker-protease site-BAM(1-22) or BAM(8-22) ligand-NheI-spacer-SpeI-PstI-XbaI-stop codon-HindIII. It is important to ensure the correct reading frame is maintained for the spacer, dynorphin and restriction sequences and that the XbaI sequence is not preceded by the bases, TC, which would result on DAM methylation. The DNA sequence is screened for restriction sequence incorporation, and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example, GenBank Release 143, 13 Sep. 2004). This optimised DNA sequence is then commercially synthesized (for example, by Entelechon, Geneart or Sigma-Genosys) and is provided in the pCR 4 vector.

Preparation of the LC/A-BAM(1-22)-$H_N$/A Fusion

In order to create the LC-linker-BAM(1-22)-spacer-$H_N$/A construct (SEQ ID NO:110), the pCR 4 vector encoding the linker-BAM(1-22)-spacer insert is cleaved with BamHI+SalI restriction enzymes. This cleaved vector then serves as the recipient vector for insertion and ligation of the LC/A DNA (SEQ ID NO:1) cleaved with BamHI+SalI. The resulting plasmid DNA is then cleaved with PstI+XbaI restriction enzymes and serves as the recipient vector for the insertion and ligation of the $H_N$/A DNA (SEQ ID NO:2) cleaved with PstI+XbaI. The final construct contains the LC-linker-BAM (1-22)-spacer-$H_N$/A ORF (SEQ ID NO:110) for transfer into expression vectors for expression to result in a fusion protein of the sequence illustrated in SEQ ID NO:111.

Preparation of the LC/A-BAM(8-22)-$H_N$/A Fusion

In order to create the LC-linker-BAM(8-22)-spacer-$H_N$/A construct, the pCR 4 vector encoding the linker-BAM(8-22)-spacer insert is cleaved with BamHI+SalI restriction enzymes. This cleaved vector then serves as the recipient vector for insertion and ligation of the LC/A DNA (SEQ ID NO:1) cleaved with BamHI+SalI. The resulting plasmid DNA is then cleaved with PstI+XbaI restriction enzymes and serves as the recipient vector for the insertion and ligation of the $H_N$/A DNA (SEQ ID NO:2) cleaved with PstI+XbaI. The final construct contains the LC-linker-BAM(8-22)-spacer-$H_N$/A ORF for transfer into expression vectors for expression to result in a fusion protein of the sequence illustrated in SEQ ID NO:113.

Preparation of Linker-Spacer-BAM8-22 Insert

The LC-$H_N$ linker can be designed from first principle, using the existing sequence information for the linker as the template. For example, the serotype A linker (in this case defined as the inter-domain polypeptide region that exists between the cysteines of the disulphide bridge between LC and $H_N$) is 23 amino acids long and has the sequence VRGI-ITSKTKSLDKGYNKALNDL (SEQ ID NO:164). Within this sequence, it is understood that proteolytic activation in nature leads to an $H_N$ domain that has an N-terminus of the sequence ALNDL (SEQ ID NO:165). This sequence information is freely available from available database sources such as GenBank (accession number P10845) or Swissprot (accession locus BXA1_CLOBO). Into this linker an enterokinase site is incorporated; and using one of a variety of reverse translation software tools [for example. EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-SalI-linker-protease site-PstI-XbaI-spacer-SpeI-BAM8-22-stop codon-HindIII. It is important to ensure the correct reading frame is maintained for the spacer, BAM and restriction sequences and that the XbaI sequence is not preceded by the bases, TC, which would result on DAM methylation. The DNA sequence is screened for restriction sequence incorporation, and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example, GenBank Release 143, 13 Sep. 2004). This optimised DNA sequence is then commercially synthesized (for example, by Entelechon, Geneart or Sigma-Genosys) and is provided in the pCR 4 vector.

Preparation of the LC/A-HN/A-BAM(8-22) Fusion

In order to create the LC/A-$H_N$/A-BAM(8-22) construct, the pCR 4 vector encoding the linker-spacer-BAM(1-22) insert is cleaved with BamHI+SalI restriction enzymes. This cleaved vector then serves as the recipient vector for insertion and ligation of the LC/A DNA (SEQ ID NO:1) cleaved with BamHI+SalI. The resulting plasmid DNA is then cleaved with PstI+XbaI restriction enzymes and serves as the recipient vector for the insertion and ligation of the $H_N$/A DNA (SEQ ID NO:2) cleaved with PstI+XbaI. The final construct contains the LC/A-linker-protease site-$H_N$/A-spacer-SpeI-BAM8-22 ORF for transfer into expression vectors for expression to result in a fusion protein of the sequence illustrated in SEQ ID NO:112.

Purification Method for BAM Fusion Proteins

The fusion proteins were purified as described in Example 40.

Example 45

Construction of CHO-K1 OPRM1 Binding Assay and NCI-H69 SNAP-25 Cleavage Assay A radioligand binding assay for measurement of the binding affinity ($pK_I$) of a range of reference ligands and fusions to human μ-opioid ($OP_3$) receptors in CHO cells stably transfected with the human μ-opioid receptors (CHO-MOR cells) was used. The assay involves the specific labeling of μ-opioid receptors (MOR) expressed in CHO cells with the MOR selective agonist radioligand [$^3$H]-DAMGO. Increasing amounts of unlabelled competing ligand (Syntaxin ligands or reference compounds) are incubated with a fixed amount of radioligand and cell membranes. Upon completion of the assay, reaction mixtures are filtered through glass fibre paper where radioactivity associated with MOR receptors becomes trapped. The radioactivity of each filter is quantified and this relates to the ability of the competing ligand to bind to the MOR receptor in place of the radioligand. Ligands better able to bind to the MOR receptor will appear to 'displace' the radiolabel at lower concentrations.

Cell Culture

CHO-MOR cells (CHO-K1 cells with stable expression of the μ ($OP_3$) Perkin Elmer ES-542-C) were cultured according to the supplier's recommendations. Cells were grown in Hams F12 containing 10% FBS and 400 μg/ml G418 at 37° C. in an atmosphere of 95% $O_2$/5% $CO_2$. Cells were passaged when cells had reached 80% confluency, typically every 3-4 days.

Cells were grown in eight T175 flasks to approximately 80% confluence, the culture medium was removed and the cells washed twice with 10-20 ml PBS. Cells were removed from the flask by addition of 5 ml of PBS based enzyme free dissociation buffer, and incubated at 37° C. for 10 min followed by gentle tapping of the flasks to dislodged cells. Ten ml of culture media was added to the flasks and the cells were transferred to a 50 ml Falcon tube. Flasks were washed with a further 20 ml culture media which was then added to the cell suspension. Cells were centrifuged (1300×g, 3 min), the supernatant removed, and the cell pellet resuspended in culture media by trituration. A cell sample was removed and the viable cell number calculated using a Nucleocounter (ChemoMetec). The volume of media was adjusted to give a final concentration of $5\times10^6$ cells/ml. One ml aliquots of the resultant cell suspension were transferred to 1.5 ml microfuge tubes and centrifuged (100×g, 5 min), the supernatant was removed and the cell pellets frozen and stored at −80° C.

Membrane Preparation

On the day of the assay, the required number of cell pellets was removed from −80° C. and 1 ml ice cold membrane preparation buffer (50 mM Tris pH 7.4 at 4° C.) was added to each pellet. Individual cell pellets were dislodged by vortexing, collected into a 40 ml centrifuge tube and the total volumes adjusted to 10 ml. Cells were homogenised (1×1 s) using an Ultra Turrax® T25-digital homogeniser (IKA-WERKE), at the highest setting (25,000 $min^{-1}$). Membranes were diluted to the required cell concentrations in Assay Buffer (50 mM Tris pH 6.96 at 21° C.) by counting the total cells in a Nucleocounter® and make to 300,000 cells/ml.

Competition Binding Assay

In order to determine the binding profile of a number of μ-opioid receptor ligands or fusions, competition binding assays were performed in which a fixed concentration of [$^3$H]-DAMGO was competed with increasing concentrations of the μ-opioid receptor ligands or fusion protein. CHO-MOR cell membranes (equivalent to 30,000 cells per well) were incubated with a fixed concentration of [$^3$H]-DAMGO (1 nM) and increasing concentrations of competing ligand or fusion (0.01 nM to 1 μM), in Assay Buffer (50 mM Tris pH 6.96 at 21° C.). To define the non-specific and total binding, each reaction was performed in the presence or absence of CTOP (1 μM). Reactions were performed, in triplicate, in deep-well 'LoBind Protein' 96-well plates (200 μl final volume) and initiated by addition of cell membranes. Assay plates were mixed, covered with a plate sealer and incubated for 1 hr at room temperature. Reactions were terminated by rapid filtration through Whatman GF/B filters using a Brandel cell harvester, filters were washed (3×3 ml) with ice-cold wash buffer (50 mM Tris-HCl, pH 7.4 at 4° C.) and transferred to scintillation vials. Scintillation fluid was added to each vial and after 3 hours bound radioactivity was quantified in a Tri-Carb 2900TR liquid scintillation analyser by counting each vial for 3 min.

NCI-H69 SNAP-25 Cleavage Assay

SNARE cleavage by betaendorphin fusions was demonstrated by developing a NCI-H69 SNAP-25 cleavage assay. This assay used the human small cell lung carcinoma cell line NCI-H69.

H69 cells were plated into poly-D-Lysine coated 96 well plates at $4\times10^5$ cells/ml. The plates were left for 24-48 hours prior to treatment. H69 feeding Medium consisted of RPMI-1640 containing 10% FBS, 4.5 g/l Glucose, 1.5 g/l Sodium bicarbonate, 1 mM Sodium Pyruvate, 10 mM HEPES, 2 mM Glutamine. 50 ml of cell media was filtered sterilised into a sterile 50 ml centrifuge tube using a syringe and 0.2 μm filter to be used to create two separate dilutions series for each TSI, with starting points at half log intervals (starting at 1 μM and 300 nM). The two resulting series were then combined into one dose curve. Each concentration was plated in triplicate across the plate with a dose curve running down the plate. By removing 125 μl media from the cell plate to be treated and adding 125 μl of each TSI solution to the well. Then the plate was placed in an incubator at 37° C., 5% $CO_2$ for 24 hours. After 24 hours, test materials/feeding medium was removed from the plate by inverting over a waste receptacle and the remaining media from each well was removed using a fine-tipped pastette. Next, the cells were lysed using Lysis buffer (25% 4× NuPAGE® LDS sample buffer, 10% 1M DTT, 65% dH$_2$O); 100 µl lysis buffer was added to each well, and the plate left at room temperature for 5 minutes. Then the lysate was transferred from each well into a 1.5 ml microcentrifuge tube using a Gilson P200 pipette and placed in a heat block pre-warmed to 90° C. for 10 minutes. SNAP-25 cleavage was then determined by Western blotting with a SNAP-25 antibody. 15 µl of lysed samples and 3 µl Invitrogen Magic Marker XP (LC5602) and 3 µl Invitrogen See Blue Plus 2 pre-stained standard (LC5925) was loaded onto Invitrogen 12% bis-tris 1 mm, 15 well gels that were immersed in Invitrogen NuPAGE® MOPS SDS Running Buffer. The gel was then run at 200 V until the Lysozyme 14 kDa marker is just above the gel base (approximately 70 minutes). Transferred proteins from the gel to a nitrocellulose membrane on an iBlot® dry blotting system from Invitrogen (IB1001UK), on program 2 (23 volts) for 6 minutes, according to the manufacturers instructions. On completion of the iBlot® program, the membrane was removed from the transfer stack and placed in a small tray containing blocking buffer (5 g Marvel® milk powder per 100 ml PBS/Tween 0.1%). The membrane was then incubated with blocking buffer solution at room temperature, on a rocker, for 60 minutes. After blocking, the primary antibody solution was added to the blocking buffer and membrane; 10µ Anti-SNAP-25 (Sigma S-9684) added per 10 ml blocking buffer (1:1000 dilution). Sigma's anti-SNAP-25 is reactive toward the whole SNAP-25 protein so it therefore recognizes the intact and cleaved SNAP-25. Membranes were incubated with primary antibody at room temperature, on a rocker, for 60 minutes. Then the membranes were washed by performing 3 rinses with PBS/Tween 0.1% and further blocking buffer added before incubating the membranes at room temperature, on a rocker, for 10 minutes. After incubation in blocking buffer the secondary antibody was added to the membrane; 20 µl of Anti-Rabbit-HRP conjugate (Sigma A-6154) was added per 40 ml blocking buffer (1:2000 dilution). The membrane was incubated with secondary antibody at room temperature, on a rocker, for 60 minutes before being washed three times with PBS/Tween (0.1%). Again, further blocking buffer was added to the membrane and the membrane incubated at room temperature, on a rocker, for 30 minutes before being washed 3 times with PBS/Tween (0.1%). Finally, detection of bound antibody solution done using Pierce West-Dura® supersignal (34075) detection reagents. The detection reagents were mixed (Luminol/Enhancer Solution, Stable Peroxide Buffer) at a 1:1 ratio (a total volume of 2 ml per mini membrane) and applied to the membrane, ensuring that the membrane is completely flat and the reagents cover it completely. The membrane was incubated for 5 minutes at room temperature before Chemiluminescent detection was performed on the GeneGnome HR Syngene system from Synoptics. The exposure was set to 5 minutes and Gene tools software from Syngene was used to calculate the relative amounts of cleaved and uncleaved SNAP-25 within each lane.

Example 46

Construction of CHO-K1 BDKRB$_1$ and CHO-K1 BDKRB$_2$ Receptor Activation Assay

CHO-K1 BDKB$_2$ Receptor Activation Assay

A receptor activation assay was developed for which stably transfected CHO-K1 cells with the B$_2$ receptor were used in a calcium fluorimetry assay measuring intracellular calcium levels. The assay allowed the measurement of the potency (pEC$_{50}$) and intrinsic efficacy (E$_{max}$) of the bradykinin ligand and fusions. The assay involves indirect measurement of B$_2$-receptor activation by measuring changes in intracellular calcium levels using a Flexstation3® and calcium-sensitive dye.

Culture of CHO-K1 B2 Cells

CHO-K1 cells with stable expression of the B$_2$ receptor (CHO-K1-B$_2$-R; ES-090-C) were purchased from Perkin Elmer. Cells were cultured in Ham's F12 containing 2 mM glutamine, 10% FBS and 400 µg/ml G418 at 37° C. in a humidified environment containing 5% CO$_2$. Cells were passaged every 3 to 5 days when cells were approximately 80% confluent. The media was removed and the cells washed twice with PBS. Cells were harvested using a PBS-based non-enzymatic cell dissociation buffer at 37° C. for 2-3 minutes, pelleted by centrifugation, resuspended in culture media and seeded into fresh T175 flasks.

Seeding of CHO-K1 B2 Cells

Cells were harvested using a PBS-based non-enzymatic cell dissociation buffer at 37° C. for 2-3 minutes. Cells were collected by centrifugation, resuspended in culture media and the cell concentration determined using a Nucleocounter (ChemoMetec). Cells were diluted in culture media to the required concentration of 2×10$^5$ cells/ml and seeded into 96-well plates at a volume of 100 µl per well. Cells were incubated at 37° C. in 5% CO$_2$ overnight.

Estimation of Potency and Intrinsic Activity of Bradykinin and BK Fusions

The following day after seeding, culture media was removed from the cells and replaced with 100 µl per well of assay buffer (HBSS with 1.26 mM CaCl$_2$, 0.49 mM MgCl$_2$, 0.4 mM MgSO$_4$ and 20 mM HEPES at pH 7.4) containing 5 mM Probenecid (Probenecid final concentration of 2.5 mM) and FLIPR calcium 4 loading dye (100 µl). Cells were incubated at 37° C. in 5% CO$_2$ for 60 min after which increasing concentrations of bradykinin (50 µl) or fusion protein were added to the cells in triplicate by the Flexstation3®. The change in fluorescent emission at 525 nm following excitation at 485 nm was determined over a 70 s time period using the FlexStation3®.

CHO-K1 BDKB$_1$ Receptor Activation Assay

An assay was also developed to allow the measurement of potency (pEC$_{50}$) and efficacy (E$_{max}$) of bradykinin ligands at the human bradykinin B$_1$ receptor stably expressed in CHO-K1 cells. This assay was similar to the B$_2$ receptor activation assay as it measured the changes in intracellular calcium levels using a calcium fluorimetry assay. CHO-K1 cells with stable expression of the B$_1$ receptor were purchased from Perkin Elmer (ES-091-C).

Culture of CHO-K1 B1 Cells

CHO-K1 cells with stable expression of the human B1 receptor (CHO-K1-B1 cells) were cultured in culture media (Ham's F12 containing 2 mM glutamine, 10% FBS and 400 µg.ml-1 G418) at 37° C. in a humidified environment containing 5% CO$_2$. Cells were passaged every 3 to 5 days when cells were approximately 80% confluent. The media was removed and the cells washed twice with PBS. Cells were harvested using a PBS-based non-enzymatic cell dissociation buffer at 37° C. for 2-3 min, pelleted by centrifugation (1,500 rpm; 3 min), re-suspended in culture media and seeded into fresh T500 flasks. Cells were pelleted by centrifugation at 1,300 rpm for 3 min in a Hereaus megafuge 1.0. Then the cell pellet was resuspended in Bambanker freezing medium to achieve a concentration of 3×10$^6$ cells/ml and aliquoted into 1.8 ml Nunc cryovials. The cryovials were transferred to a cryo vial rack and stored at −80° C. overnight before transferring the vials to the short-term liquid nitrogen store.

Seeding of CHO-K1 B1 Cells

The day before the assay, cell vials were removed from the liquid nitrogen store and thawed quickly by placing vials in a 37° C. water bath. Cells were then pelleted by centrifuging at 1,300 rpm for 3 min in a Hereaus megafuge 1.0. The cell pellet was re-suspend in 2 ml media/vial and the number of viable cells in the suspension counted using the Nucleocounter. Added media to the cell suspension to achieve a cell concentration of $1 \times 10^6$ cells/ml. Then the cells were plated in a Corning black walled, clear-bottom, half-area plate at a density of 20,000 viable cells/well; using a Rainin E8-300 multi-channel pipette added 30 µl media to each well followed by 20 µl/well of the $1 \times 10^6$ cells/ml cell suspension. Maintained the plates overnight at 37° C. in a humidified environment containing 5% $CO_2$.

Estimation of Potency and Intrinsic Activity of des-Arg Bradykinin and BK Fusions Next day the plates were incubated (37° C. in a humidified environment containing 5% $CO_2$) in HBSS modified assay buffer (with 1.26 mM $CaCl_2$, 0.49 mM $MgCl_2$, 0.4 mM $MgSO_4$ and 20 mM HEPES at pH 7.4) containing x 0.5 $Ca^{2+}$-dye, Probenecid (2.5 mM). After 1 hour, increasing concentrations of des-$Arg^9$-BK and fusion proteins were added to the cells in triplicate rows by the FlexStation3® (height 70 µl; speed 16 µl/s; 37° C.). The fluorescence emitted at 525 nm was measured over a 60 s time period and expressed as percent increase in baseline RFU.

Example 47

Construction and Activation of Bradykinin Fusion Proteins

Following the methods used in Examples 1 and 2, the LC/A (SEQ ID NO:1) and $H_N/A$ (SEQ ID NO:2) are created and inserted into the A serotype bradykinin linker arranged as BamHI-SalI-linker-protease site-PstI-XbaI-spacer-SpeI-bradykinin-stop codon-HindIII. The final construct contains the LC/A-linker-protease site-HN/A-spacer-SpeI-Bradykinin ORF (SEQ ID NO:119) for expression as a protein of the sequence illustrated in SEQ ID NO:120.

Alternatively, the bradykinin (SEQ ID NO:117) in the bradykinin linker was replaced by des $Arg^9$-bradykinin (SEQ ID NO:118) so that the final construct contains the LC/A-linker-protease site-HN/A-spacer-SpeI-des $Arg^9$-Bradykinin ORF for expression as a protein of the sequence illustrated in SEQ ID NO:121.

Purification Method for Bradykinin Fusion Proteins

The fusion proteins were purified as described in Example 40.

Example 48

Construction and Activation of Substance P Fusion Proteins

Following the methods used in Examples 1 and 2, the LC/A (SEQ ID NO:1) and $H_N/A$ (SEQ ID NO:2) are created and inserted into the A serotype substance P analogue (S6) linker arranged as BamHI-SalI-linker-protease site-PstI-XbaI-spacer-SpeI-substance P(S6)-stop codon-HindIII. The final construct contains the LC/A-linker-protease site-HN/A-spacer-SpeI-substance P(S6) ORF for expression as a protein of the sequence illustrated in SEQ ID NO:124.

Purification Method for Substance P Fusion Proteins

The fusion proteins were purified as described in Example 40.

Example 49

A method of treating, preventing or ameliorating pain in a subject, comprising administration to said patient a therapeutic effective amount of fusion protein, wherein said pain is selected from the group consisting of: chronic pain arising from malignant disease, chronic pain not caused by malignant disease (peripheral neuropathies).

Patient A

A 73 year old woman suffering from severe pain caused by posthepatic neuralgia is treated by a peripheral injection with fusion protein to reduce neurotransmitter release at the synapse of nerve terminals to reduce the pain. The patient experiences good analgesic effect within 2 hours of said injection.

Patient B

A 32 year old male suffering from phantom limb pain after having his left arm amputated following a car accident is treated by peripheral injection with fusion protein to reduce the pain. The patient experiences good analgesic effect within 1 hour of said injection.

Patient C

A 55 year male suffering from diabetic neuropathy is treated by a peripheral injection with fusion protein to reduce neurotransmitter release at the synapse of nerve terminals to reduce the pain. The patient experiences good analgesic effect within 4 hours of said injection.

Patient D

A 63 year old woman suffering from cancer pain is treated by a peripheral injection with fusion protein to reduce neurotransmitter release at the synapse of nerve terminals to reduce the pain. The patient experiences good analgesic effect within 4 hours of said injection.

All documents, books, manuals, papers, patents, published patent applications, guides, abstracts and other reference materials cited herein are incorporated by reference in their entirety. While the foregoing specification teaches the principles of the present invention, with examples provided for the purpose of illustration, it will be appreciated by one skilled in the art from reading this disclosure that various changes in form and detail can be made without departing from the true scope of the invention.

While illustrative embodiments have been illustrated and described, it will be appreciated that various changes can be made therein without departing from the spirit and scope of the invention.

SEQUENCE LISTING (165 sequences)

SEQ ID NO: 1 - DNA, 1302 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgac

SEQ ID NO: 2 - DNA, 1257 bp, Artificial Sequence
  Synthetic
ctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactagaagctt

SEQ ID NO: 3 - DNA, 1323 bp, Artificial Sequence
  Synthetic
ggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgcgtcgac

SEQ ID NO: 4 - DNA, 1260 bp, Artificial Sequence
  Synthetic
ctgcagtgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaactctctagactagaagctt

SEQ ID NO: 5 - DNA, 1329 bp, Artificial Sequence
  Synthetic
ggatccgaattcatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgac

SEQ ID NO: 6 - DNA, 1263 bp, Artificial Sequence
  Synthetic
ctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactagaagctt

SEQ ID NO: 7 - DNA, 207 bp, Artificial Sequence
  Synthetic
ggatccacgcacgtcgacggcatcattacctccaaaactaaatctctgatcgaaggtcgttttggcggtttcacgggcgcacgcaaatcagcgcgtaaattagctaaccaggcgctagcgggcggtggcggtagcggcggtggcggtagcggcggtggcggtagcgcactagtgctgcagacgcacggtctagaatgataaaagctt

SEQ ID NO: 8 - DNA, 108 bp, Artificial Sequence
  Synthetic
ggatccacgcacgtcgacggcatcattacctccaaaactaaatctctgatagaaggtagaaacaaagcgctgaacctgcagacgcacggtctagaatgataaaagctt

SEQ ID NO: 9 - DNA, 186 bp, Artificial Sequence
  Synthetic
catatgaataacctcgggattgagggtcgttttggcggtttcacgggcgcacgcaaatcagcgcgtaaattagctaaccagactagtggcggtgggggtagtggcggtggcggttcgggcgggggtgggagccctaggggatccgtcgacctgcagggtctagaagcgctagcgtgataaaagctt

SEQ ID NO: 10 - DNA, 180 bp, Artificial Sequence
  Synthetic
ggatccacgcacgtcgacgcgattgatggtcgttttggcggtttcacgggcgcacgcaaatcagcgcgtaaattagctaaccaggcgctagcgggcggtggcggtagcggcggtggcggtagcggcggtggcggtagcgcactagtgctgcagacgcacggtctagaatgataaaagctt

SEQ ID NO: 11 - DNA, 249 bp, Artificial Sequence
  Synthetic
ggatccacgcacgtcgacggcatcattacctccaaaactaaatctctgatcgaaggtcgttacggtggtttcatgacctctgaaaaatctcagaccccgctggttaccctgttcaaaaacgctatcatcaaaaacgcttacaaaaaaggtgaagcgctagcgggtggtggtggttctggtggtggtggttctggtggtggtggttctgcactagtgctgcagacgcacggtctagaatgataaaagctt

SEQ ID NO: 12 - DNA, 207 bp, Artificial Sequence
  Synthetic
ggatccacgcacgtcgacggcatcattacctccaaaactaaatctctgatcgaaggtcgttttggcggtttcacgggcgcacgcaaatcagcgcgtaaacgtaagaaccaggcgctagcgggcggtggcggtagcggcggtggcggtagcggcggtggcggtagcgcactagtgctgcagacgcacggtctagaatgataaaagctt

SEQ ID NO: 13 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaattagctaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 14 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKLANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 15 - DNA, 2736 bp, Artificial Sequence
  Synthetic
ctcgggattgagggtcgttttggcggtttcacgggcgcacgcaaatcagcgcgtaaattagctaaccagactagtggcggtgggggtagtggcggtggcggttcgggcgggggtgggagccctaggggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagaaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 16 - protein, 911 aa, Artificial Sequence
  Synthetic
LGIEGRFGGFTGARKSARKLANQTSGGGGSGGGGSGGGGSPRGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 17 - DNA, 2715 bp, Artificial Sequence
  Synthetic
ggatccgaattcatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacgcgatagatggtagatttggcggtttcacgggcgcacgcaaatcagcgcgtaaattagctaaccaggcgctagcgggcggtggcggtagcggcggtggcggtagcggcggtggcggtagcgcactagtgctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactag

SEQ ID NO: 18 - protein, 904 aa, Artificial Sequence
  Synthetic
GSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRFGGFTGARKSARKLANQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLD

SEQ ID NO: 19 - DNA, 2742 bp, Artificial Sequence
  Synthetic
ggatccgaattcatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacggcatcattacctccaaaactaaatctctgatagaaggtagatttggcggtttcacgggcgcacgcaaatcagcgcgtaaattagctaaccaggcgctagcgggcggtggcggtagcggcggtggcggtagcggcggtggcggtagcgcactagtgctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactag

SEQ ID NO: 20 - protein, 913 aa, Artificial Sequence
  Synthetic
GSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRFGGFTGARKSARKLANQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLD

SEQ ID NO: 21 - DNA, 2673 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatacggtggtttcatggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 22 - protein, 890 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFMALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 23 - DNA, 2751 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatcgaaggtcgttacggtggtttcatgacctctgaaaaatctcagaccccgctggttaccctgttcaaaaacgctatcatcaaaaacgcttacaaaaaaggtgaagcgctagcgggtggtggtggttctggtggtggtggttctggtggtggtggttctgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 24 - protein, 916 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFMTSEKSQTPLVTLFKNAIIKNAYKKGEALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 25 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 26 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 27 - DNA, 2691 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 28 - protein, 896 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSAALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 29 - DNA, 2691 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatatgcggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 30 - protein, 896 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKYAALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 31 - DNA, 2691 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcatatgcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 32 - protein, 896 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSYALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 33 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaatatgctaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 34 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKYANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 35 - DNA, 2697 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaagcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 36 - protein, 898 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 37 - DNA, 51 bp, Artificial Sequence
  Synthetic
tttggcggtttcacgggcgcacgcaaatcagcgcgtaaattagctaaccag

SEQ ID NO: 38 - protein, 17 aa, Artificial Sequence
  Synthetic
FGGFTGARKSARKLANQ

SEQ ID NO: 39 - DNA, 33 bp, Artificial Sequence
  Synthetic
tttggcggtttcacgggcgcacgcaaatcagcg

SEQ ID NO: 40 - protein, 11 aa, Artificial Sequence
  Synthetic
FGGFTGARKSA

SEQ ID NO: 41 - DNA, 33 bp, Artificial Sequence
  Synthetic
tttggcggtttcacgggcgcacgcaaatatgcg

SEQ ID NO: 42 - protein, 11 aa, Artificial Sequence
  Synthetic
FGGFTGARKYA

SEQ ID NO: 43 - DNA, 33 bp, Artificial Sequence
  Synthetic
tttggcggtttcacgggcgcacgcaaatcatat

SEQ ID NO: 44 - protein, 11 aa, Artificial Sequence
  Synthetic
FGGFTGARKSY

SEQ ID NO: 45 - DNA, 51 bp, Artificial Sequence
  Synthetic
tttggcggtttcacgggcgcacgcaaatcagcgcgtaaatatgctaaccag

SEQ ID NO: 46 - protein, 17 aa, Artificial Sequence
  Synthetic
FGGFTGARKSARKYANQ

SEQ ID NO: 47 - DNA, 39 bp, Artificial Sequence
  Synthetic
tttggcggtttcacgggcgcacgcaaatcagcgcgtaaa

SEQ ID NO: 48 - protein, 13 aa, Artificial Sequence
  Synthetic
FGGFTGARKSARK

SEQ ID NO: 49 - DNA, 51 bp, Artificial Sequence
  Synthetic
tttggcggtttcacgggcgcacgcaaatcagcgcgtaaacgcaaaaaccag

SEQ ID NO: 50 - protein, 17 aa, Artificial Sequence
  Synthetic
FGGFTGARKSARKRKNQ

SEQ ID NO: 51 - DNA, 2736 bp, Artificial Sequence
  Synthetic
ctcgggattgagggtcgttttggcggtttcacgggcgcacgcaaatcagcgcgtaaattagctaaccagactagtggcggtgggggtagtggcggtggcggttcgggcgggggtgggagccctaggggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagaaacaaagcgctgaacctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 52 - protein, 911 aa, Artificial Sequence
  Synthetic
LGIEGRFGGFTGARKSARKLANQTSGGGGSGGGGSGGGGSPRGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 53 - DNA, 177 bp, Artificial Sequence
  Synthetic
ggatccacgcacgtcgacggcatcattacctccaaaactaaatctctgatagaaggtagatttggcggtttcacgggcgcacgcaaatcagcgcgtaaattagctaaccaggcgctagcgggtggtggtggttctgcactagtgctgcagacgcacggtctagaatgataaaagctt

SEQ ID NO: 54 - DNA, 192 bp, Artificial Sequence
  Synthetic
ggatccacgcacgtcgacggcatcattacctccaaaactaaatctctgatagaaggtagatttggcggtttcacgggcgcacgcaaatcagcgcgtaaattagctaaccaggcgctagcgggtggtggtggttctggtggtggtggttctgcactagtgctgcagacgcacggtctagaatgataaaagctt

SEQ ID NO: 55 - DNA, 222 bp, Artificial Sequence
  Synthetic
ggatccacgcacgtcgacggcatcattacctccaaaactaaatctctgatagaaggtagatttggcggtttcacgggcgcacgcaaatcagcgcgtaaattagctaaccaggcgctagcgggtggtggtggttctggtggtggtggttctggtggtggtggttctggtggtggtggttctgcactagtgctgcagacgcacggtctagaatgataaaagctt

SEQ ID NO: 56 - DNA, 237 bp, Artificial Sequence
  Synthetic
ggatccacgcacgtcgacggcatcattacctccaaaactaaatctctgatagaaggtagatttggcggtttcacgggcgcacgcaaatcagcgcgtaaattagctaaccaggcgctagcgggtggtggtggttctggtggtggtggttctggtggtggtggttctggtggtggtggttctggtggtggtggttctgcactagtgctgcagacgcacggtctagaatgataaaagctt

SEQ ID NO: 57 - DNA, 228 bp, Artificial Sequence
  Synthetic
ggatccacgcacgtcgacggcatcattacctccaaaactaaatctctgatagaaggtagatttggcggtttcacgggcgcacgcaaatcagcgcgtaaattagctaaccaggcgctagcggctgaagctgctgctaaagaagctgctgctaaagaagctgctgctaaagctggtggcggtggttccgcactagtgctgcagacgcacggtctagaatgataaaagctt

SEQ ID NO: 58 - DNA, 2694 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaattagctaaccaggcgctagcgggtggtggtggttctggtggtggtggttctgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 59 - protein, 897 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKLANQALAGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 60 - DNA, 2724 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaattagctaaccaggcgctagcgggtggtggtggttctggtggtggtggttctggtggtggtggttctggtggtggtggttctgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 61 - protein, 907 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKLANQALAGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 62 - DNA, 207 bp, Artificial Sequence
  Synthetic
ggatccacgcacgtcgacggcatcattacctccaaaactaaatctgacgatgacgataaatttggcggtttcacgggcgcacgcaaatcagcgcgtaaacgtaagaaccaggcgctagcgggcggtggcggtagcggcggtggcggtagcggcggtggcggtagcgcactagtgctgcagacgcacggtctagaatgataaaagctt

SEQ ID NO: 63 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctgacgatgacgataaatttggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 64 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 65 - DNA, 207 bp, Artificial Sequence
  Synthetic
ggatccacgcacgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagacgcacggtctagaatgataaaagctt

SEQ ID NO: 66 - DNA, 2742 bp, Artificial Sequence
  Synthetic
ggatccgaattcatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactag

SEQ ID NO: 67 - protein, 913 aa, Artificial Sequence
  Synthetic
GSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRFGGFTGARKSARKRKNQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLD

SEQ ID NO: 68 - DNA, 2673 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatacggtggtttcctggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 69 - protein, 890 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFLALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 70 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatatggcggtttcacgggcgcacgcaaatcagcgcgtaaattagctaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 71 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFTGARKSARKLANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 72 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatatggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 73 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 74 - DNA, 2889 bp, Artificial Sequence
  Synthetic
ggatccttggtacgagatgacgttgactatcaaattttccgcgactttgcggaaaataaaggtaagtttttcgtcggcgccacagacctgtccgtcaaaaataagagaggccagaacatcggtaacgcactgagcaacgtccctatgattgattttagtgtagcggacgttaataaacggattgcaaccgtcgttgatccgcagtatgctgtcagcgtcaaacatgctaaagcggaagttcatacgttctattacgggcaatataacggccataacgatgtggctgataaagaaaatgaatatcgcgtggtcgagcagaacaattacgaaccgcacaaagcgtggggcgcgagtaatttaggccgcctggaggactataacatggcccgtttcaataaattcgtgaccgaggtagcaccgatcgcccccacagatgctggtgggggcctggatacctacaaagataaaaaccgcttctctagcttcgtgcgcattggcgccggtcgtcagctcgtgtacgagaagggtgtctatcaccaggaaggtaatgaaaaggggtacgacctccgtgatttgtcccaggcgtatcgctacgctattgccggaaccccgtataaagatattaatatcgatcaaaccatgaataccgaaggcctaattggtttcgggaatcataataagcaatatagcgcagaagagctaaagcaggccctcagccaagatgcgttaaccaattacggagtgttaggcgatagcggcagtccgctgtttgccttcgataaacagaaaaatcaatgggtgtttctgggcacttatgattattgggccggatatggtaaaaagagctggcaggaatggaatatttataaaaaggaattcgcagacaaaatcaagcagcatgacaacgcaggtacggtgaaggggaacggcgaacatcactggaagacgaccggcacgaatagtcatatcggatcgacggccgttcgcctggcgaacaatgagggcgatgcaaacaatgggcaaaacgtgacctttgaggacaacggtaccctggtccttaaccagaacataaatcagggcgcgggaggcttgttctttaaaggcgactatactgttaagggagcaaacaatgacatcacctggttaggggccggtattgacgttgcggatggaaaaaaggtggtttggcaggttaaaaaccctaacggggaccggctggcaaaaatcggcaaagggacattggaaattaatggtaccggtgtgaatcagggtcagctgaaagtgggagatgggaccgtgattctgaaccagaaagcagacgctgacaaaaaggtgcaagcctttagccaagtaggaattgttagtggtcgtggcacactcgtcttgaactcaagcaaccaaataaatccggataacctgtactttggatttcgtggcggacgcctggatgctaacgggaatgatctgacctttgaacatatccgtaacgttgacgagggtgcgcgcatagttaatcataatactgaccatgcatcaactatcaccttgaccgggaaaagtctgattacaaacccaaactctctgtcagtacattccatccagaatgattatgatgaagacgattactcatactattaccggccgcgtagaccaattccacaaggtaaagatctttattacaaaaattaccgttattacgcattaaaatccggagggcggctgaatgcacctatgccggaaaatggcgtggccgaaaacaatgactggatttttatgggttatactcaagaagaggctcgcaaaaatgcaatgaaccataaaaataaccgaaggatcggtgatttcggcggatttttcgatgaggaaaatggtaaaggtcacaatggtgcgctgaatctaaattttaacggcaaaagtgcccagaaacgtttccttctgactggtggcgctaatctgaatggtaaaatcagtgtgacgcagggtaacgtgctgctttctggccggccaactccgcatgcacgtgattttgtaaataaatcgagcgctcgtaaagatgcgcatttttctaaaaataacgaggtcgtgtttgaagatgactggataaatcgcacctttaaagcggcagaaatcgcggttaatcagagtgcgagcttttcatcgggtaggaatgtatctgatattacagcaaacattacagccactgataatgcgaaggtcaacctgggttataaaaacggtgatgaagtttgtgttcgatcggattacacgggctatgttacctgcaacactggcaatctgtctgataaagcgcttaactcttttgacgccacgcgcattaacgggaatgtgaacctgaaccaaaacgctgccttggtacttggtaaggccgcgttgtggggtaaaattcagggccagggcaactcccgtgtgtctctgaaccagcactcgaagtggcacctgacgggggactcgcaggtgcacaacttgtccctggccgatagccatattcaccttaacaatgcgtccgatgcccagtcagctaataaatatcatacgatcaaaatcaatcacctctctggcaacggtcactttcactacttaacggatttagcaaaaaacttaggggataaagtcctggtaaaagaatcagcgagcggacattatcagttacatgtacagaacaaaacaggcgagccaaatcaggaaggccttgacttatttgatgcttcatcggtacaagatcgttccagactgttcgtttcactcgcgaatcactacgttgatctgggtgcgctgcgctatactataaagacggaaaatggcataacacgcctctataatccctatgccggtaacggccgtccggtgaaacctgctccctgcgtcgac

SEQ ID NO: 75 - DNA, 4296 bp, Artificial Sequence
  Synthetic
ggatccttggtacgagatgacgttgactatcaaattttccgcgactttgcggaaaataaaggtaagtttttcgtcggcgccacagacctgtccgtcaaaaataagagaggccagaacatcggtaacgcactgagcaacgtccctatgattgattttagtgtagcggacgttaataaacggattgcaaccgtcgttgatccgcagtatgctgtcagcgtcaaacatgctaaagcggaagttcatacgttctattacgggcaatataacggccataacgatgtggctgataaagaaaatgaatatcgcgtggtcgagcagaacaattacgaaccgcacaaagcgtggggcgcgagtaatttaggccgcctggaggactataacatggcccgtttcaataaattcgtgaccgaggtagcaccgatcgcccccacagatgctggtgggggcctggatacctacaaagataaaaaccgcttctctagcttcgtgcgcattggcgccggtcgtcagctcgtgtacgagaagggtgtctatcaccaggaaggtaatgaaaaggggtacgacctccgtgatttgtcccaggcgtatcgctacgctattgccggaaccccgtataaagatattaatatcgatcaaaccatgaataccgaaggcctaattggtttcgggaatcataataagcaatatagcgcagaagagctaaagcaggccctcagccaagatgcgttaaccaattacggagtgttaggcgatagcggcagtccgctgtttgccttcgataaacagaaaaatcaatgggtgtttctgggcacttatgattattgggccggatatggtaaaaagagctggcaggaatggaatatttataaaaaggaattcgcagacaaaatcaagcagcatgacaacgcaggtacggtgaaggggaacggcgaacatcactggaagacgaccggcacgaatagtcatatcggatcgacggccgttcgcctggcgaacaatgagggcgatgcaaacaatgggcaaaacgtgacctttgaggacaacggtaccctggtccttaaccagaacataaatcagggcgcgggaggcttgttctttaaaggcgactatactgttaagggagcaaacaatgacatcacctggttaggggccggtattgacgttgcggatggaaaaaaggtggtttggcaggttaaaaaccctaacggggaccggctggcaaaaatcggcaaagggacattggaaattaatggtaccggtgtgaatcagggtcagctgaaagtgggagatgggaccgtgattctgaaccagaaagcagacgctgacaaaaaggtgcaagcctttagccaagtaggaattgttagtggtcgtggcacactcgtcttgaactcaagcaaccaaataaatccggataacctgtactttggatttcgtggcggacgcctggatgctaacgggaatgatctgacctttgaacatatccgtaacgttgacgagggtgcgcgcatagttaatcataatactgaccatgcatcaactatcaccttgaccgggaaaagtctgattacaaacccaaactctctgtcagtacattccatccagaatgattatgatgaagacgattactcatactattaccggccgcgtagaccaattccacaaggtaaagatctttattacaaaaattaccgttattacgcattaaaatccggagggcggctgaatgcacctatgccggaaaatggcgtggccgaaaacaatgactggatttttatgggttatactcaagaagaggctcgcaaaaatgcaatgaaccataaaaataaccgaaggatcggtgatttcggcggatttttcgatgaggaaaatggtaaaggtcacaatggtgcgctgaatctaaattttaacggcaaaagtgcccagaaacgtttccttctgactggtggcgctaatctgaatggtaaaatcagtgtgacgcagggtaacgtgctgctttctggccggccaactccgcatgcacgtgattttgtaaataaatcgagcgctcgtaaagatgcgcatttttctaaaaataacgaggtcgtgtttgaagatgactggataaatcgcacctttaaagcggcagaaatcgcggttaatcagagtgcgagcttttcatcgggtaggaatgtatctgatattacagcaaacattacagccactgataatgcgaaggtcaacctgggttataaaaacggtgatgaagtttgtgttcgatcggattacacgggctatgttacctgcaacactggcaatctgtctgataaagcgcttaactcttttgacgccacgcgcattaacgggaatgtgaacctgaaccaaaacgctgccttggtacttggtaaggccgcgttgtggggtaaaattcagggccagggcaactcccgtgtgtctctgaaccagcactcgaagtggcacctgacgggggactcgcaggtgcacaacttgtccctggccgatagccatattcaccttaacaatgcgtccgatgcccagtcagctaataaatatcatacgatcaaaatcaatcacctctctggcaacggtcactttcactacttaacggatttagcaaaaaacttaggggataaagtcctggtaaaagaatcagcgagcggacattatcagttacatgtacagaacaaaacaggcgagccaaatcaggaaggccttgacttatttgatgcttcatcggtacaagatcgttccagactgttcgtttcactcgcgaatcactacgttgatctgggtgcgctgcgctatactataaagacggaaaatggcataacacgcctctataatccctatgccggtaacggccgtccggtgaaacctgctccctgcgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 76 - protein, 1431 aa, Artificial Sequence
  Synthetic
GSLVRDDVDYQIFRDFAENKGKFFVGATDLSVKNKRGQNIGNALSNVPMIDFSVADVNKRIATVVDPQYAVSVKHAKAEVHTFYYGQYNGHNDVADKENEYRVVEQNNYEPHKAWGASNLGRLEDYNMARFNKFVTEVAPIAPTDAGGGLDTYKDKNRFSSFVRIGAGRQLVYEKGVYHQEGNEKGYDLRDLSQAYRYAIAGTPYKDINIDQTMNTEGLIGFGNHNKQYSAEELKQALSQDALTNYGVLGDSGSPLFAFDKQKNQWVFLGTYDYWAGYGKKSWQEWNIYKKEFADKIKQHDNAGTVKGNGEHHWKTTGTNSHIGSTAVRLANNEGDANNGQNVTFEDNGTLVLNQNINQGAGGLFFKGDYTVKGANNDITWLGAGIDVADGKKVVWQVKNPNGDRLAKIGKGTLEINGTGVNQGQLKVGDGTVILNQKADADKKVQAFSQVGIVSGRGTLVLNSSNQINPDNLYFGFRGGRLDANGNDLTFEHIRNVDEGARIVNHNTDHASTITLTGKSLITNPNSLSVHSIQNDYDEDDYSYYYRPRRPIPQGKDLYYKNYRYYALKSGGRLNAPMPENGVAENNDWIFMGYTQEEARKNAMNHKNNRRIGDFGGFFDEENGKGHNGALNLNFNGKSAQKRFLLTGGANLNGKISVTQGNVLLSGRPTPHARDFVNKSSARKDAHFSKNNEVVFEDDWINRTFKAAEIAVNQSASFSSGRNVSDITANITATDNAKVNLGYKNGDEVCVRSDYTGYVTCNTGNLSDKALNSFDATRINGNVNLNQNAALVLGKAALWGKIQGQGNSRVSLNQHSKWHLTGDSQVHNLSLADSHIHLNNASDAQSANKYHTIKINHLSGNGHFHYLTDLAKNLGDKVLVKESASGHYQLHVQNKTGEPNQEGLDLFDASSVQDRSRLFVSLANHYVDLGALRYTIKTENGITRLYNPYAGNGRPVKPAPCVDGIITSKTKSLIEGRFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 77 - DNA, 1357 bp, Artificial Sequence
  Synthetic
gctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagaaatagaaggtagaagtgggcaccatcaccatcaccattaatgaaagctt

SEQ ID NO: 78 - DNA, 2745 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagaaatagaaggtagaagtgggcaccatcaccatcaccattaa

SEQ ID NO: 79 - protein, 914 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEIEGRSGHHHHHH

SEQ ID NO: 80 - DNA, 619 bp, Artificial Sequence
  Synthetic
gctagcgggcggtggcggtagcggcggtggcggtagcggcggtggcggtagcgcactagtgctgcagtgtatcaatctggattgggacgtaatccgtgataagaccaaaacaaaaatcgagtctttgaaagaacacggcccgatcaaaaataagatgtctgaatcacccaataaaactgtttcggaggaaaaagcgaaacagtatttggaagagtttcatcaaaccgcgcttgaacatccggagctcagtgaactgaaaacagtgacgggaacgaatcctgtttttgcaggcgcaaactatgcggcttgggccgtgaatgttgcccaagtaattgatagtgagaccgcagacaacctggaaaagacgaccgcagcgttaagcattttaccggggattggttccgtgatgggtatagcggatggagcggtccaccataacactgaggaaattgtcgcccagtcaatcgctctgagttccctgatggttgcacaggctatcccactcgtgggggaactggttgacataggtttcgccgcctacaacttcgtagaaagcattattaatctttttcaggtggtgcataacagctacaaccgccctctagaatgataaaagctt

SEQ ID NO: 81 - DNA, 1971 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatacggtggtttcctggcgctagcgggcggtggcggtagcggcggtggcggtagcggcggtggcggtagcgcactagtgctgcagtgtatcaatctggattgggacgtaatccgtgataagaccaaaacaaaaatcgagtctttgaaagaacacggcccgatcaaaaataagatgtctgaatcacccaataaaactgtttcggaggaaaaagcgaaacagtatttggaagagtttcatcaaaccgcgcttgaacatccggagctcagtgaactgaaaacagtgacgggaacgaatcctgtttttgcaggcgcaaactatgcggcttgggccgtgaatgttgcccaagtaattgatagtgagaccgcagacaacctggaaaagacgaccgcagcgttaagcattttaccggggattggttccgtgatgggtatagcggatggagcggtccaccataacactgaggaaattgtcgcccagtcaatcgctctgagttccctgatggttgcacaggctatcccactcgtgggggaactggttgacataggtttcgccgcctacaacttcgtagaaagcattattaatctttttcaggtggtgcataacagctacaaccgccctctagaatga

SEQ ID NO: 82 - protein, 656 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFLALAGGGGSGGGGSGGGGSALVLQCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPLE

SEQ ID NO: 83 - DNA, 1329 bp, Artificial Sequence
  Synthetic
ggatccatgcctattactattaacaattttcgttatagcgatcccgtcaacaatgacaccattatcatgatggaaccgccatattgcaaaggactggacatttactataaagccttcaagattactgaccgcatttggattgttccagagcgttacgagttcgggacgaaaccagaagattttaacccgccttcatcgctgatcgaaggagcatcagagtattacgatccgaactatctgcgtacggacagcgataaagaccgcttcttacagaccatggtcaaactttttaaccgtattaagaacaatgtggccggagaagcactcttggataagattatcaacgcgattccatacctgggcaattcttacagcctgctggataaatttgacacaaatagtaattcagtcagctttaacctgttagaacaagatccgagtggcgcaaccacgaagtctgccatgctgacaaatctgatcatttttggtccaggtcctgtactgaataaaaatgaagtacgcggcatcgttctccgcgtggacaataagaactacttcccatgccgtgacggcttcggttcgatcatgcagatggctttctgtccggagtacgttccgacgtttgataatgttattgagaatatcacgagtttaacaatcggtaagtcaaaatattttcaagatccggcccttctccttatgcatgaactgattcacgtgctgcacggcttatatggtatgcaagtgtcctcgcatgaaatcattccgtccaaacaggaaatttatatgcagcatacctacccgatttcagctgaagagttgtttacgtttggtggccaggacgcgaatttgatctccatcgacatcaaaaacgatctgtatgagaaaacattaaatgactataaagcgattgcgaacaaactgtctcaggtgactagctgcaacgatcctaacattgatattgattcctacaaacaaatttatcaacagaaataccagttcgataaagacagcaatggtcagtatatcgtaaacgaagataaatttcagatcctgtataacagcattatgtatggctttaccgaaattgagttggggaagaaatttaacattaaaacccgtctgtcttattttagtatgaaccatgatccggtgaaaatccccaatctgcttgatgataccatttataatgataccgaagggttcaacattgaatctaaggatctgaaatccgaatacaaaggccaaaatatgcgtgttaatactaacgctttccgtaatgttgatggtagtggactcgtctcgaaactgattgggttgtgtgtcgac

SEQ ID NO: 84 - DNA, 2736 bp, Artificial Sequence
  Synthetic
ggatccatgcctattactattaacaattttcgttatagcgatcccgtcaacaatgacaccattatcatgatggaaccgccatattgcaaaggactggacatttactataaagccttcaagattactgaccgcatttggattgttccagagcgttacgagttcgggacgaaaccagaagattttaacccgccttcatcgctgatcgaaggagcatcagagtattacgatccgaactatctgcgtacggacagcgataaagaccgcttcttacagaccatggtcaaactttttaaccgtattaagaacaatgtggccggagaagcactcttggataagattatcaacgcgattccatacctgggcaattcttacagcctgctggataaatttgacacaaatagtaattcagtcagctttaacctgttagaacaagatccgagtggcgcaaccacgaagtctgccatgctgacaaatctgatcatttttggtccaggtcctgtactgaataaaaatgaagtacgcggcatcgttctccgcgtggacaataagaactacttcccatgccgtgacggcttcggttcgatcatgcagatggctttctgtccggagtacgttccgacgtttgataatgttattgagaatatcacgagtttaacaatcggtaagtcaaaatattttcaagatccggcccttctccttatgcatgaactgattcacgtgctgcacggcttatatggtatgcaagtgtcctcgcatgaaatcattccgtccaaacaggaaatttatatgcagcatacctacccgatttcagctgaagagttgtttacgtttggtggccaggacgcgaatttgatctccatcgacatcaaaaacgatctgtatgagaaaacattaaatgactataaagcgattgcgaacaaactgtctcaggtgactagctgcaacgatcctaacattgatattgattcctacaaacaaatttatcaacagaaataccagttcgataaagacagcaatggtcagtatatcgtaaacgaagataaatttcagatcctgtataacagcattatgtatggctttaccgaaattgagttggggaagaaatttaacattaaaacccgtctgtcttattttagtatgaaccatgatccggtgaaaatccccaatctgcttgatgataccatttataatgataccgaagggttcaacattgaatctaaggatctgaaatccgaatacaaaggccaaaatatgcgtgttaatactaacgctttccgtaatgttgatggtagtggactcgtctcgaaactgattgggttgtgtgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 85 - protein, 911 aa, Artificial Sequence
  Synthetic
GSMPITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLCVDGIITSKTKSLIEGRFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 86 - DNA, 180 bp, Artificial Sequence
  Synthetic
ggatccacgcacgtcgacgcgattgatggtcgttttggcggtttcacgggcgcacgcaaatcagcgcgtaaacgtaagaaccaggcgctagcgggcggtggcggtagcggcggtggcggtagcggcggtggcggtagcgcactagtgctgcagacgcacggtctagaatgataaaagctt

SEQ ID NO: 87 - DNA, 2715 bp, Artificial Sequence
  Synthetic
ggatccgaattcatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacgcgattgatggtcgttttggcggtttcacgggcgcacgcaaatcagcgcgtaaacgtaagaaccaggcgctagcgggcggtggcggtagcggcggtggcggtagcggcggtggcggtagcgcactagtgctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactag

SEQ ID NO: 88 - protein, 904 aa, Artificial Sequence
  Synthetic
GSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRFGGFTGARKSARKRKNQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLD

SEQ ID NO: 89 - protein, 17 aa, Artificial Sequence
  Synthetic
YGGFLRRIRPKLKWDNQ

SEQ ID NO: 90 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctgacgatgacgataaatatggaggttttttgagaaggatacgaccaaaattaaagtgggataatcaagcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 91 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 92 - protein, 892 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 93 - protein, 897 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 94 - protein, 907 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 95 - protein, 913 aa, Artificial Sequence
  Synthetic
GSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSDDDDKYGGFLRRIRPKLKWDNQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLD

SEQ ID NO: 96 - protein, 1432 aa, Artificial Sequence
  Synthetic
GSLVRDDVDYQIFRDFAENKGKFFVGATDLSVKNKRGQNIGNALSNVPMIDFSVADVNKRIATVVDPQYAVSVKHAKAEVHTFYYGQYNGHNDVADKENEYRVVEQNNYEPHKAWGASNLGRLEDYNMARFNKFVTEVAPIAPTDAGGGLDTYKDKNRFSSFVRIGAGRQLVYEKGVYHQEGNEKGYDLRDLSQAYRYAIAGTPYKDINIDQTMNTEGLIGFGNHNKQYSAEELKQALSQDALTNYGVLGDSGSPLFAFDKQKNQWVFLGTYDYWAGYGKKSWQEWNIYKKEFADKIKQHDNAGTVKGNGEHHWKTTGTNSHIGSTAVRLANNEGDANNGQNVTFEDNGTLVLNQNINQGAGGLFFKGDYTVKGANNDITWLGAGIDVADGKKVVWQVKNPNGDRLAKIGKGTLEINGTGVNQGQLKVGDGTVILNQKADADKKVQAFSQVGIVSGRGTLVLNSSNQINPDNLYFGFRGGRLDANGNDLTFEHIRNVDEGARIVNHNTDHASTITLTGKSLITNPNSLSVHSIQNDYDEDDYSYYYRPRRPIPQGKDLYYKNYRYYALKSGGRLNAPMPENGVAENNDWIFMGYTQEEARKNAMNHKNNRRIGDFGGFFDEENGKGHNGALNLNFNGKSAQKRFLLTGGANLNGKISVTQGNVLLSGRPTPHARDFVNKSSARKDAHFSKNNEVVFEDDWINRTFKAAEIAVNQSASFSSGRNVSDITANITATDNAKVNLGYKNGDEVCVRSDYTGYVTCNTGNLSDKALNSFDATRINGNVNLNQNAALVLGKAALWGKIQGQGNSRVSLNQHSKWHLTGDSQVHNLSLADSHIHLNNASDAQSANKYHTIKINHLSGNGHFHYLTDLAKNLGDKVLVKESASGHYQLHVQNKTGEPNQEGLDLFDASSVQDRSRLFVSLANHYVDLGALRYTIKTENGITRLYNPYAGNGRPVKPAPCVDGIITSKTKSLDDDDKYGGFLRRIRPKLKWDNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 97 - protein, 911 aa, Artificial Sequence
  Synthetic
GSMPITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLCVDGIITSKTKSDDDDKYGGFLRRIRPKLKWDNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 98 - protein, 912 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 99 - protein, 909 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAAEAAAKEAAAKEAAAKAGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 100 - protein, 910 aa, Artificial Sequence
  Synthetic sequence
GSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSDDDDKYGGFLRRIRPKLKWDNQALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLD

SEQ ID NO: 101 - protein, 898 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 102 - protein, 902 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 103 - protein, 912 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWANQALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 104 - protein, 908 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 105 - protein, 902 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRRRRKLKWANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 106 - protein, 898 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRRRRKLKALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 107 - protein, 902 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 108 - protein, 22 aa, Artificial Sequence
  Synthetic sequence
YGGFMRRVGRPEWWMDYQKRYG

SEQ ID NO: 109 - protein, 15 aa, Artificial Sequence
  Synthetic sequence
VGRPEWWMDYQKRYG

SEQ ID NO: 110 - DNA, 2724 bp, Artificial Sequence
  Synthetic sequence
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctgacgatgacgataaatacggtggtttcatgcgtcgtgtcggtcgcccggaatggtggatggactatcaaaagcgttacggcgcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 111 - protein, 907 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFMRRVGRPEWWMDYQKRYGALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 112 - protein, 902 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVVGRPEWWMDYQKRYG

SEQ ID NO: 113 - protein, 900 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKVGRPEWWMDYQKRYGALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 114 - protein, 31 aa, Artificial Sequence
  Synthetic sequence
YGGFMTSEKSQTPLVTLFKNAIIKNAYKKGE

SEQ ID NO: 115 - protein, 924 aa, Artificial Sequence
  Synthetic sequence
GSMTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYGGFMTSEKSQTPLVTLFKNAIIKNAYKKGEALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLD

SEQ ID NO: 116 - protein, 924 aa, Artificial Sequence
  Synthetic sequence
GSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSLIEGRYGGFMTSEKSQTPLVTLFKNAIIKNAYKKGEALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLD

SEQ ID NO: 117 - protein, 9 aa, Artificial Sequence
  Synthetic sequence
RPPGFSPFR

SEQ ID NO: 118 - protein, 8 aa, Artificial Sequence
  Synthetic sequence
RPPGFSPF

SEQ ID NO: 119 - DNA, 2697 bp, Artificial Sequence
  Synthetic sequence
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagaaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagaaggcggtggcggtagcggcggtggcggtagcggcggtggcggtagcgcactagtgcgtccgccgggtttctctccgttccgttagaagctt

SEQ ID NO: 120 - protein, 896 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVRPPGFSPFR

SEQ ID NO: 121 - protein, 895 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVRPPGFSPF

SEQ ID NO: 122 - protein, 11 aa, Artificial Sequence
  Synthetic sequence
RPKPQQFFGLM

SEQ ID NO: 123 - protein, 11 aa, Artificial Sequence
  Synthetic sequence
KRAKFMMFFGL

SEQ ID NO: 124 - protein, 898 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVKRAKFMMFFGL

SEQ ID NO: 125 - protein, 910 aa, Artificial Sequence
  Synthetic sequence
GSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSDDDDKFGGFTGARKSARKRKNQALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLD

SEQ ID NO: 126 - protein, 910 aa, Artificial Sequence
  Synthetic sequence
GSMTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKFGGFTGARKSARKRKNQALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLD

SEQ ID NO: 127 - DNA, 1323 bp, Artificial Sequence
  Synthetic sequence
ggatccatgacgtggccagttaaggatttcaactactcagatcctgtaaatgacaacgatattctgtaccttcgcattccacaaaataaactgatcaccacaccagtcaaagcattcatgattactcaaaacatttgggtcattccagaacgcttttctagtgacacaaatccgagtttatctaaacctccgcgtccgacgtccaaatatcagagctattacgatccctcatatctcagtacggacgaacaaaaagatactttccttaaaggtatcattaaactgtttaagcgtattaatgagcgcgatatcgggaaaaagttgattaattatcttgttgtgggttccccgttcatgggcgatagctctacccccgaagacacttttgattttacccgtcatacgacaaacatcgcggtagagaagtttgagaacggatcgtggaaagtcacaaacatcattacacctagcgtcttaatttttggtccgctgccaaacatcttagattatacagccagcctgactttgcaggggcaacagtcgaatccgagtttcgaaggttttggtaccctgagcattctgaaagttgccccggaatttctgctcactttttcagatgtcaccagcaaccagagctcagcagtattaggaaagtcaattttttgcatggacccggttattgcactgatgcacgaactgacgcactctctgcatcaactgtatgggatcaacatccccagtgacaaacgtattcgtccccaggtgtctgaaggatttttctcacaggatgggccgaacgtccagttcgaagagttgtatactttcggaggcctggacgtagagatcattccccagattgagcgcagtcagctgcgtgagaaggcattgggccattataaggatattgcaaaacgcctgaataacattaacaaaacgattccatcttcgtggatctcgaatattgataaatataagaaaatttttagcgagaaatataattttgataaagataatacaggtaactttgtggttaacattgacaaattcaactccctttacagtgatttgacgaatgtaatgagcgaagttgtgtatagttcccaatacaacgttaagaatcgtacccattacttctctcgtcactacctgccggttttcgcgaacatccttgacgataatatttacactattcgtgacggctttaacttgaccaacaagggcttcaatattgaaaattcaggccagaacattgaacgcaacccggccttgcagaaactgtcgagtgaatccgtggttgacctgtttaccaaagtctgcgtcgac

SEQ ID NO: 128 - DNA, 1260 bp, Artificial Sequence
  Synthetic sequence
ctgcagtgtattaaagtgaaaaacaatcggctgccttatgtagcagataaagatagcattagtcaggagattttcgaaaataaaattatcactgacgaaaccaatgttcagaattattcagataaattttcactggacgaaagcatcttagatggccaagttccgattaacccggaaattgttgatccgttactgccgaacgtgaatatggaaccgttaaacctccctggcgaagagatcgtattttatgatgacattacgaaatatgtggactaccttaattcttattactatttggaaagccagaaactgtccaataacgtggaaaacattactctgaccacaagcgtggaagaggctttaggctactcaaataagatttataccttcctcccgtcgctggcggaaaaagtaaataaaggtgtgcaggctggtctgttcctcaactgggcgaatgaagttgtcgaagactttaccacgaatattatgaaaaaggataccctggataaaatctccgacgtctcggttattatcccatatattggccctgcgttaaatatcggtaatagtgcgctgcgggggaattttaaccaggcctttgctaccgcgggcgtcgcgttcctcctggagggctttcctgaatttactatcccggcgctcggtgtttttacattttactcttccatccaggagcgtgagaaaattatcaaaaccatcgaaaactgcctggagcagcgggtgaaacgctggaaagattcttatcaatggatggtgtcaaactggttatctcgcatcacgacccaattcaaccatattaattaccagatgtatgatagtctgtcgtaccaagctgacgccattaaagccaaaattgatctggaatataaaaagtactctggtagcgataaggagaacatcaaaagccaggtggagaaccttaagaatagtctggatgtgaaaatctctgaagctatgaataacattaacaaattcattcgtgaatgttcggtgacgtacctgttcaagaatatgctgccaaaagttattgatgaactgaataaatttgatctgcgtaccaaaaccgaacttatcaacctcatcgactcccacaacattatccttgtgggcgaagtggatcgtctgaaggccaaagtaaacgagagctttgaaaatacgatgccgtttaatattttttcatataccaataactccttgctgaaagatatcatcaatgaatatttcaatctagactagaagctt

SEQ ID NO: 129 - protein, 906 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALD

SEQ ID NO: 130 - protein, 909 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALD

SEQ ID NO: 131 - protein, 903 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 132 - protein, 906 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVVGRPEWWMDYQKRYG

SEQ ID NO: 133 - protein, 912 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKVGRPEWWMDYQKRYGALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 134 - protein, 919 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFMRRVGRPEWWMDYQKRYGALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 135 - protein, 931 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFMTSEKSQTPLVTLFKNAIIKNAYKKGEALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 136 - protein, 928 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFMTSEKSQTPLVTLFKNAIIKNAYKKGEALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 137 - protein, 936 aa, Artificial Sequence
  Synthetic sequence
MGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSLIEGRYGGFMTSEKSQTPLVTLFKNAIIKNAYKKGEALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLEALASGHHHHHH

SEQ ID NO: 138 - protein, 936 aa, Artificial Sequence
  Synthetic sequence
MGSMTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYGGFMTSEKSQTPLVTLFKNAIIKNAYKKGEALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEALASGHHHHHH

SEQ ID NO: 139 - protein, 900 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVRPPGFSPFR

SEQ ID NO: 140 - protein, 914 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 141 - protein, 910 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 142 - protein, 924 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 143 - protein, 920 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 144 - protein, 914 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 145 - protein, 924 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWANQALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 146 - protein, 922 aa, Artificial Sequence
  Synthetic sequence
MGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSDDDDKYGGFLRRIRPKLKWDNQALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLEALASGHHHHHH

SEQ ID NO: 147 - protein, 914 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRRRRKLKWANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 148 - protein, 910 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRRRRKLKALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 149 - protein, 921 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAAEAAAKEAAAKEAAAKAGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 150 - protein, 914 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 151 - protein, 917 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 152 - protein, 928 aa, Artificial Sequence
  Synthetic sequence
ISEFGSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRFGGFTGARKSARKRKNQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEALASGHHHHHH

SEQ ID NO: 153 - protein, 925 aa, Artificial Sequence
  Synthetic sequence
ISEFGSMTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKFGGFTGARKSARKRKNQALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEALASGHHHHHH

SEQ ID NO: 154 - protein, 917 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKLANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 155 - protein, 922 aa, Artificial Sequence
  Synthetic sequence
MGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSDDDDKFGGFTGARKSARKRKNQALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLEALASGHHHHHH

SEQ ID NO: 156 - protein, 917 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 157 - protein, 902 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVKRAKFMMFFGL

SEQ ID NO: 158 - protein, 5 aa, Artificial Sequence
  Synthetic
DDDDK

SEQ ID NO: 159 - protein, 4 aa, Artificial Sequence
  Synthetic
  MISC_FEATURE (2)..(2): Wherein the Xaa at position 2 is Glu or Asp
IXGR

SEQ ID NO: 160 - protein, 7 aa, Tobacco etch virus
ENLYFQG

SEQ ID NO: 161 - protein, 6 aa, Artificial Sequence
  Synthetic
LVPRGS

SEQ ID NO: 162 - protein, 8 aa, Artificial Sequence
  Synthetic
LEVLFQGP

SEQ ID NO: 163 - protein, 23 aa, Influenza virus
GLFGAIAGFIENGWEGMIDGWYG

SEQ ID NO: 164 - protein, 23 aa, Clostridium botulinum
VRGIITSKTKSLDKGYNKALNDL

SEQ ID NO: 165 - protein, 5 aa, Artificial Sequence
  Synthetic
ALNDL

The invention claimed is:

1. A method of treating or ameliorating pain in a subject, comprising administering to said subject a therapeutically effective amount of a polypeptide fusion protein comprising:
   a. a non cytotoxic protease, or a fragment thereof, which protease or protease fragment cleaves a protein of the exocytic fusion apparatus of a nociceptive sensory afferent;
   b. a Targeting Moiety that binds to a Binding Site on the nociceptive sensory afferent, which Binding Site endocytoses to be incorporated into an endosome within the nociceptive sensory afferent;
   c. a protease cleavage site at which site the fusion protein is cleavable by a protease,
   wherein the protease cleavage site is located between the non cytotoxic protease or fragment thereof and the Targeting Moiety;
   d. a translocation domain that translocates the protease or protease fragment from within an endosome, across the endosomal membrane and into the cytosol of the nociceptive sensory afferent;
   wherein the Targeting Moiety is selected from the group consisting of BAM, β endorphin, bradykinin, substance P, dynorphin and/or nociception;
   wherein said polypeptide fusion protein comprises an amino acid sequence selected from the group consisting of SEQ ID NOs: 24, 98, 99, 100, 101, 102, 103, 104, 105, 106, 107, 111, 112, 113, 115, 116, 120, 121, 124, 125, 126, 129, 130, 131, 132, 133, 134, 135, 136, 137, 138, 139, 140, 141, 142, 143, 144, 145, 146, 147, 148, 149, 150, 151, 152, 153, 154, 155, 156, and/or 157.

2. A method according to claim 1, wherein the pain is chronic pain selected from neuropathic pain, inflammatory pain, headache pain, somatic pain, visceral pain, and referred pain.

* * * * *